US011603405B2

(12) United States Patent
Gaudet et al.

(10) Patent No.: US 11,603,405 B2
(45) Date of Patent: *Mar. 14, 2023

(54) ANTI-CD3 ANTIBODIES AND USES THEREOF

(71) Applicant: Janssen Biotech, Inc., Horsham, PA (US)

(72) Inventors: Francois Gaudet, Princeton, NJ (US); Jill Giles-Komar, Downingtown, PA (US); Bradley Heidrich, Gilbertsville, PA (US); Chichi Huang, Malvern, PA (US); Colleen Kane, Flourtown, PA (US); Ronan McDaid, Eagleville, PA (US); Jennifer Nemeth-Seay, Fort Washington, PA (US)

(73) Assignee: JANSSEN BIOTECH, INC., Horsham, PA (US)

( * ) Notice: Subject to any disclaimer, the term of this patent is extended or adjusted under 35 U.S.C. 154(b) by 227 days.

This patent is subject to a terminal disclaimer.

(21) Appl. No.: 16/418,082

(22) Filed: May 21, 2019

(65) Prior Publication Data

US 2020/0048349 A1 Feb. 13, 2020

Related U.S. Application Data

(60) Provisional application No. 62/676,081, filed on May 24, 2018.

(51) Int. Cl.
| | | |
|---|---|---|
| *C07K 16/28* | (2006.01) | |
| *A61P 35/00* | (2006.01) | |
| *A61K 39/395* | (2006.01) | |
| *C07K 16/30* | (2006.01) | |
| *A61K 39/00* | (2006.01) | |

(52) U.S. Cl.
CPC .... *C07K 16/2809* (2013.01); *A61K 39/39541* (2013.01); *A61P 35/00* (2018.01); *C07K 16/28* (2013.01); *C07K 16/2803* (2013.01); *C07K 16/3069* (2013.01); *A61K 2039/505* (2013.01); *C07K 2317/21* (2013.01); *C07K 2317/24* (2013.01); *C07K 2317/31* (2013.01); *C07K 2317/55* (2013.01); *C07K 2317/92* (2013.01)

(58) Field of Classification Search
None
See application file for complete search history.

(56) References Cited

U.S. PATENT DOCUMENTS

| | | |
|---|---|---|
| 5,223,409 A | 6/1993 | Ladner et al. |
| 5,225,539 A | 7/1993 | Winter |
| 5,403,484 A | 4/1995 | Ladner et al. |
| 5,427,908 A | 6/1995 | Dower et al. |
| 5,571,698 A | 11/1996 | Ladner et al. |
| 5,580,717 A | 12/1996 | Dower et al. |
| 5,885,793 A | 3/1999 | Griffiths et al. |
| 5,969,108 A | 10/1999 | McCafferty et al. |
| 6,150,584 A | 11/2000 | Kucherlapati et al. |
| 6,172,197 B1 | 1/2001 | McCafferty et al. |
| 6,180,370 B1 * | 1/2001 | Queen .................... A61P 31/12 435/69.6 |
| 6,521,404 B1 | 2/2003 | Griffiths et al. |
| 6,521,427 B1 | 2/2003 | Evans |
| 6,544,731 B1 | 4/2003 | Griffiths et al. |
| 6,555,313 B1 | 4/2003 | Griffiths et al. |
| 6,582,915 B1 | 6/2003 | Griffiths et al. |
| 6,593,081 B1 | 7/2003 | Griffiths et al. |
| 6,670,127 B2 | 12/2003 | Evans |
| 6,818,749 B1 | 11/2004 | Kashmiri et al. |
| 7,709,226 B2 | 5/2010 | Foote |
| 8,242,247 B2 | 8/2012 | Klein et al. |
| 8,748,356 B2 | 6/2014 | Raghunathan |
| 10,465,006 B2 * | 11/2019 | Van Den Brink . C07K 16/4241 |
| 2007/0287170 A1 | 12/2007 | Davis et al. |
| 2009/0182127 A1 | 7/2009 | Kjaergaard et al. |

(Continued)

FOREIGN PATENT DOCUMENTS

| | | |
|---|---|---|
| EP | 2982693 A1 | 2/2016 |
| WO | WO 88/01649 A1 | 3/1988 |

(Continued)

OTHER PUBLICATIONS

Alegre, M L et al. "A non-activating "humanized" anti-CD3 monoclonal antibody retains immunosuppressive properties in vivo." Transplantation vol. 57,11 (1994): 1537-43. (Year: 1994).*
Labrijn, Aran F et al. "Therapeutic IgG4 antibodies engage in Fab-arm exchange with endogenous human IgG4 in vivo." Nature biotechnology vol. 27,8 (2009): 767-71. doi:10.1038/nbt.1553 (Year: 2009).*
Rich, Rebecca L., and David G. Myszka. "Higher-throughput, label-free, real-time molecular interaction analysis." Analytical biochemistry 361.1 (2006): 1-6. (Year: 2006).*
Janeway, Charles A. "Immunobiology: The Immune System in Health and Disease." 2005 (Year: 2005).*

(Continued)

*Primary Examiner* — Michael Szperka
*Assistant Examiner* — Lia E Taylor
(74) *Attorney, Agent, or Firm* — Riverside Law LLP

(57) ABSTRACT

The present invention relates to antibodies that specifically bind CD3. The present invention relates to antibodies that specifically bind PSMA. The present invention relates to antibodies that specifically bind CD3 and PSMA. The present invention relates to antibodies that specifically bind IL1RAP. The present invention relates to antibodies that specifically bind CD33. The present invention relates to antibodies that specifically bind CD3 and IL1RAP. The present invention relates to antibodies that specifically bind CD3 and CD33. The present invention relates to antibodies that specifically bind TMEFF2. The present invention relates to antibodies that specifically bind CD3 and TMEFF2. The present invention relates to fragments of the antibodies, polynucleotides encoding the antibodies or fragments thereof, and methods of making and using the same.

45 Claims, 104 Drawing Sheets

Specification includes a Sequence Listing.

(56) References Cited

U.S. PATENT DOCUMENTS

| | | |
|---|---|---|
| 2010/0015133 A1 | 1/2010 | Igawa et al. |
| 2010/0028637 A1 | 2/2010 | Tavsanli et al. |
| 2010/0261620 A1 | 10/2010 | Almagro et al. |
| 2011/0123532 A1 | 5/2011 | Gurney et al. |
| 2012/0149876 A1 | 6/2012 | Von Kreudenstein et al. |
| 2013/0195849 A1 | 8/2013 | Spreter Von Kreudenstein et al. |
| 2017/0121420 A1 | 5/2017 | Heidrich et al. |
| 2018/0057597 A1* | 3/2018 | Albrecht ............ C07K 16/2809 |
| 2019/0352421 A1* | 11/2019 | Adams .................... A61K 45/06 |
| 2020/0190205 A1* | 6/2020 | Adams ............... C07K 16/3061 |

FOREIGN PATENT DOCUMENTS

| | | |
|---|---|---|
| WO | WO 90/04036 A1 | 4/1990 |
| WO | WO 90/07861 A1 | 7/1990 |
| WO | WO 92/01047 A1 | 1/1992 |
| WO | WO 92/22653 A1 | 12/1992 |
| WO | WO 94/13804 A1 | 6/1994 |
| WO | WO 98/44001 A1 | 10/1998 |
| WO | WO 99/45962 A1 | 9/1999 |
| WO | WO 02/43478 A2 | 6/2002 |
| WO | WO 02/43478 A3 | 6/2002 |
| WO | WO 02/43478 A8 | 6/2002 |
| WO | WO 02/066630 A1 | 8/2002 |
| WO | WO 2006/028936 A2 | 3/2006 |
| WO | WO 2006/028936 A3 | 3/2006 |
| WO | WO 2009/018386 A1 | 2/2009 |
| WO | WO 2009/080251 A1 | 7/2009 |
| WO | WO 2009/080252 A1 | 7/2009 |
| WO | WO 2009/080254 A1 | 7/2009 |
| WO | WO 2009/085462 A1 | 7/2009 |
| WO | WO 2011/131746 A2 | 10/2011 |
| WO | WO 2011/131746 A3 | 10/2011 |
| WO | 2012162067 | 11/2012 |
| WO | WO 2014/093908 A2 | 6/2014 |
| WO | WO 2014/093908 A3 | 6/2014 |
| WO | WO 2015/181098 A1 | 12/2015 |
| WO | 2018052503 | 3/2018 |
| WO | 2019224711 | 11/2019 |
| WO | 2019224713 | 11/2019 |
| WO | 2019224718 | 11/2019 |

OTHER PUBLICATIONS

Sela-Culang, Inbal, Vered Kunik, and Yanay Ofran. "The structural basis of antibody-antigen recognition." Frontiers in immunology 4 (2013): 302 (Year: 2013).*

Janeway, Charles A. "Immunobiology: The Immune System in Health and Disease." 2001 (Year: 2001).*

Kipriyanov, Sergey M., and Fabrice Le Gall. "Generation and production of engineered antibodies." Molecular biotechnology 26.1 (2004): 39-60. (Year: 2004).*

Ying et al., "Anti-idiotypic antibodies: biological function and structural studies.", The FASEB Journal, Federation of American Societies For Experimental Biology, Jan. 1, 1995, pp. 43-49, vol. 9(1), XP002526815.

International Search Report relating to corresponding International Patent Application No. PCT/IB2019/054188, filed May 21, 2019. Date of Mailing of International Search Report: dated Jan. 23, 2020.

Written Opinion of the International Searching Authority relating to corresponding International Patent Application No. PCT/IB2019/054188, filed May 21, 2019. Date of Mailing of Written Opinion: dated Jan. 23, 2020.

Adan, A., et al., "Flow cytometry: basic principles and applications", Crit Rev Biotechnol, (2017), vol. 37, No. 2, pp. 163-176.

Brüggemann, M., et al., "Human antibody production in transgenic mice: expression from 100 kb of the human IgH locus", Eur. J. Immunol., (1991), vol. 21, pp. 1323-1326.

Brüggemann, M., et al., "Production of human antibody repertoires in transgenic mice", Current Opinion in Biotechnology, (1997), vol. 8, pp. 455-458.

Chames, P., et al., "Bispecific antibodies for cancer therapy", Current Opinion in Drug Discovery & Development, (2009), vol. 12, No. 2, pp. 276-283.

Chothia, C., et al., "Canonical Structures for the Hypervariable Regions of Immunoglobulins", J. Mol. Biol., (1987), vol. 196, pp. 901-917.

Cline, M.J., et al., "Perspectives for Gene Therapy: inserting new genetic information into mammalian cells by physical techniques and viral vectors", Pharmac. Ther., (1985), vol. 29, pp. 69-92.

Fishwild, D.M., et al., "High-avidity human IgGk monoclonal antibodies from a novel strain of minilocus transgenic mice", Nature Biotechnology, (1996), vol. 14, pp. 845-851.

Freshney, R.I., et al., "Culture of Animal Cells: A Manual of Basic Technique, $3^{rd}$ edition", Journal of Immunological Methods, (1995), vol. 183, pp. 291-292.

Gadi, V.K., et al., "In vivo sensitization of ovarian tumors to chemotherapy by expression of E. coli purine nucleoside phosphorylase in a small fraction of cells", Gene Therapy, (2000), vol. 7, pp. 1738-1743.

Green, L.L., "Antibody engineering via genetic engineering of the mouse: XenoMouse strains are a vehicle for the facile generation of therapeutic human monoclonal antibodies", Journal of Immunological Methods, (1999), vol. 231, pp. 11-23.

Green, L.L., et al., "Regulation of B Cell Development by Variable Gene Complexity in Mice Reconstituted with Human Immunoglobulin Yeast Artificial Chromosomes", J. Exp. Med., (1998), vol. 188, No. 3, pp. 483-495.

Green, L.L., et al., "Antigen-specific human monoclonalo antibodies from mice engineered with human Ig heavy and light chain YACs", Nature Genetics, (1994), vol. 7, pp. 13-21.

Honegger, A. et al., "Yet Another Numbering Scheme for Immunoglobulin Variable Domains: An Automatic Modeling and Analysis Tool", J. Mol. Biol., (2001), vol. 309, pp. 657-670.

Hoogenboom, H.R., et al., "By-passing Immunisation Human Antibodies from Synthetic Repertoires of Germline $V_H$ Gene Segments Rearranged in Vitro", J. Mol. Biol., (1992), vol. 227, pp. 381-388.

Huang, J., et al., "Recruitment of IRAK to the interleukin 1 receptor complex requires interleukin 1 receptor accessory protein", Proc. Natl. Acad. Sci., (1997), vol. 94, vol. 24, pp. 12829-12832.

Knappik, A., et al., "Fully Synthetic Human Combinatorial Antibody Libraries (HuCAL) Based on Modular Consensus Frameworks and CDRs Randomized with Trinucleotides", J. Mol. Biol., (2000), vol. 296, pp. 57-86.

Krebs, B., et al., "High-throughput generation and engineering of recombinant human antibodies", Journal of Immunological Methods, (2001), vol. 254, pp. 67-84.

Labrijn, A.F., et al., "Efficient generation of stable bispecific IgG1 by controlled Fab-arm exchange", PNAS, (2013), vol. 110, No. 13, pp. 5145-5150.

Labrijn, A.F., et al., "Controlled Fab-arm exchange for the generation of stable bispecific IgG1", Nature Protocols, (2014), vol. 9, No. 10, pp. 2450-2463.

Lathey, J.L., et al., "Production and characterization of an anti-idiotypic antibody specific for a monoclonal antibody to glycoprotein D of herpes simplex virus", Immunology, (1986), vol. 57, pp. 29-35.

Lefranc, M.P., et al., "IMGT unique numbering for immunoglobulin and T cell receptor variable domains and Ig superfamily V-like domains", Developmental and Comparative Immunology, (2003), vol. 27, pp. 55-77.

Lefranc, M.P., et al., "IMGT®, the international ImMunoGeneTics information system®", Nucleic Acids of Research, (2009), vol. 37, pp. D1006-D1012.

Lonberg, N., et al., "Human Antibodies from Transgenic Mice", Intern. Rev. Immunol., (1995), vol. 13, pp. 65-93.

Lonberg, N., et al., "Antigen-specific human antibodies from mice comprising four distinct genetic modifications", Nature, (1994), vol. 368, pp. 856-859.

Marks, J.D., et al., "By-passing Immunization Human Antibodies from V-gene Libraries Displayed on Phase", J. Mol. Biol., (1991), vol. 222, pp. 581-597.

Martin, A.C.R., et al., "Structural Families in Loops of Homologous Proteins: Automatic Classification, Modelling and Application to Antibodies", J. Mol. Biol., (1996), vol. 263, pp. 800-815.

(56) References Cited

OTHER PUBLICATIONS

Mendez, M.J., et al., "Functional transplant of megabase human immunoglobulin loci recapitulates human antibody response in mice", Nature Genetics, (1997), vol. 15, pp. 146-156.

Nunez-Prado, N., et al., "The coming of age of engineered multivalent antibodies", Drug Discovery Today, (2015), vol. 20, No. 5, pp. 588-594.

Okayama, H., et al., "A cDNA Cloning Vector That Permits Expression of cDNA Inserts in Mammalian Cells", Molecular and Cellular Biology, (1983), vol. 3, No. 2, pp. 280-289.

Osborn, M.J., et al., "High-Affinity IgG Antibodies Develop Naturally in Ig-Knockout Rats Carrying Germline Human IgH/IgK/Igλ Loci Bearing the Rat $C_H$ Region", J. Immunol, (2013), vol. 190, No. 4, pp. 1481-1490.

Padlan, E.A., "A Possible Procedure for Reducing the Immunogenicity of Antibody Variable Domains While Preserving Their Ligand-Binding Properties", Molecular Immunology, (1991), vol. 28, Nos. 4/5, pp. 489-498.

Pascal, B.D., et al., "HDX Workbench: Software for the Analysis of H/D Exchange MS Data", J. Am. Soc. Mass Spectrum, (2012), vol. 23, pp. 1512-1521.

Troy, D.B., "Remington: The Science and Practice of Pharmacy", $21^{st}$ Edition, Lippincott, Williams & Wilkins, (2006), Table of Contents.

Sheets, M.D., et al., "Efficient construction of a large nonimmune phage antibody library: The production of high-affinity human single-chain antibodies to protein antigens", Proc. Natl. Acad. Sci., (1998), vol. 95, pp. 6157-6162.

Shi, L., et al., "De Novo Selection of High-Affinity Antibodies from Synthetic Fab Libraries Displayed on Phage as pIX Fusion Proteins", J. Mol. Biol., (2010), vol. 397, pp. 385-396.

Thalmann, G.N., et al., "Androgen-independent Cancer Progression and Bone Metastasis in the LNCaP Model of Human Prostate Cancer", Cancer Research, (1994), vol. 54, pp. 2577-2581.

Vaughan, T.J., et al., "Human Antibodies with Sub-nanomolar Affinities Isolated from a Large Non-immunized Phage Display Library", Nature Biotechnology, (1996), vol. 14, pp. 309-314.

Wranik, B.J., et al., "LUZ-Y, a Novel Platform for the Mammalian Cell Production of Full-length IgG-bispecific Antibodies", Journal of Biological Chemistry, (2012), vol. 287, 52, pp. 43331-43339.

Wu, T.T., et al., "An Analysis of the Sequences of the Variable Regions of Bence Jones Proteins and Myeloma Light Chains and Their Implications for Antibody Complementarity", J. Exp. Med., (1970), vol. 132, pp. 211-250.

Yang, X.D., et al., "Eradication of Established Tumors by a Fully Human Monoclonal Antibody to the Epidermal Growth Factor Receptor without Concomitant Chemotherapy", Cancer Research, (1999), vol. 59, pp. 1236-1243.

Goding, "Monoclonal Antibodies: Principles and Practice", Academic Press, (1996), pp. 59-103.

Heinz Kohler et al: "The Promise of Anti-idiotype Revisited", Frontiers in Immunology, vol. 10, Apr. 1, 2019.

www.Rockland-Inc.com: "Anti-Idiotypic Antibody Production Service", , Nov. 12, 2019 (Nov. 12, 2019), XP055642733, Retrieved from the Internet: URL:https://rockland-inc.com/anti-idiotypic-antibody-production.aspx.

* cited by examiner

Fig. 1A

```
VH
                      1                                                    50
BLW-2B4-gamma    (1)  QVQLQQSGPGLVKPSQTLSLTCAISGDSVFNNNAAWSWIRQSPSRGLEWL
BLW-3B4-gamma    (1)  QVQLQQSGPGLVKPSQTLSLTCAISGDSVFNNNAAWSWIRQSPSRGLEWL
BLX-1F8-gamma    (1)  QVQLQQSGPGLVKPSQTLSLTCAISGDSVFNNNAAWSWIRQSPSRGLEWL
BLX-3G8-gamma    (1)  QVQLQQSGPGLVKPSQTLSLTCAISGDSVFNNNAAWTWIRQSPSRGLEWL
BLX-3F4-gamma    (1)  QVRLQQSGPGLVKPSQTLSLTCAISGDSVFNNNAAWSWIRQSPSRGLEWL
BLW-2E6-gamma    (1)  QVQLQQSGPRLVRPSQTLSLTCAISGDSVFNNNAAWSWIRQSPSRGLEWL
BLX-2E9-gamma    (1)  QVQLQQSGPGLVKPSQTLSLTCAISGDSVFNNNGAWSWIRQSPSRGLEWL
IGHV6-1*01_Homo  (1)  QVQLQQSGPGLVKPSQTLSLTCAISGDSVSSNSAAWNWIRQSPSRGLEWL
                                                   CDR1

51                                                   100
BLW-2B4-gamma   (51)  GRTYYRSKWLYDYAVSVKSRITVNPDTSRNQFTLQLNSVTPEDTALYYCV
BLW-3B4-gamma   (51)  GRTYYRSKWLYDYAVSVKSRITVNPDTSRNQFTLQLNSVTPEDTALYYCV
BLX-1F8-gamma   (51)  GRTYYRSKWLYDYAVSVKSRITVNPDTSRNQFTLQLKSVTPEDTALYYCS
BLX-3G8-gamma   (51)  GRTYYRSKWLYDYAVSVKSRITVNPDTSRNQFTLQLKSVTPEDTALYYCS
BLX-3F4-gamma   (51)  GRTYYRSKWLYDYAVTVKSRITVNPDTSRNQFTLQLTSVTPEDTALYYCA
BLW-2E6-gamma   (51)  GRTYYRSKWLYDYAVSVKSRITVNPDTSRNQFTLQLNSVTPEDTALYYCA
BLX-2E9-gamma   (51)  GRTYYRSKWLYDYAVSVKSRITVNPDTSRNQFTLQLNSVTPEDTALYYCA
IGHV6-1*01_Homo (51)  GRTYYRSKWYNDYAVSVKSRITINPDTSKNQFSLQLNSVTPEDTAVYYCA
                         CDR2

101           120
BLW-2B4-gamma   (101) RGYSSSFDYWGQGTLVTVSS
BLW-3B4-gamma   (101) RGYSSSFDYWGQGTLVTVSS
BLX-1F8-gamma   (101) RGYSSSFDYWGQGTLVTVSS
BLX-3G8-gamma   (101) RGYSSSFDYWGQGTLVTVSS
BLX-3F4-gamma   (101) RGYSSSFDYWGQGTLVTVSS
BLW-2E6-gamma   (101) RGYSSSFDYWGQGTLVTVSS
BLX-2E9-gamma   (101) RGYSSSFDYWGQGTLVTVSS
IGHV6-1*01_Homo (101) R-------------------
                          CDR3
```

Fig. 1B

```
VL
                         1                                                  50
  BLW-2B4-lambda    (1)  QSALTQPASVSGSPGQSITISCTGTSRDIGTYKFVSWYQQHPDKAPKVLL
  BLW-3B4-lambda    (1)  QSALTQPASVSGSPGQSITISCTGTSRDIGTYKFVSWYQQHPDKAPKVLL
  BLX-1F8-lambda    (1)  QSALTQPASVSGSPGQSITISCTGTSSDIGTYKFVSWYQQHPDKAPKVLL
  BLW-2E6-lambda    (1)  QSALTQPASVSGSPGQSITISCTGTSSNIGTYKFVSWYQQHPDKAPKVLL
  BLX-2E9-lambda    (1)  QSALTQPASVSGSPGQSITISCTGTSSNIGTYKFVSWYQQHPDKAPKVLL
  BLX-3F4-lambda    (1)  QSALTQPASVSGSPGQSITISCTGTSSNIGTYKFVSWYQQHPDKAPKVLL
  BLX-3G8-lambda    (1)  QSALTQPASVSGSPGQSITISCTGTSSNIGTYKFVSWYQQHPDKAPKVLL
  IGLV2-23*02_Homo  (1)  QSALTQPASVSGSPGQSITISCTGTSSDVGSYNLVSWYQQHPGKAPKLMI
                                                 CDR1

51                                                100
  BLW-2B4-lambda   (51)  YEVNKRPSGVSSRFSGSKSGNTASLTISGLQAEDQADYHCCSYAGSGTLL
  BLW-3B4-lambda   (51)  YEVSKRPSGVSSRFSGSKSGNTASLTISGLQAEDQADYHCCSYAGSGTLL
  BLX-1F8-lambda   (51)  YEVSKRPSGVSSRFSGSKSDNTASLTISGLQAEDQADYHCCSYAGSGTLL
  BLW-2E6-lambda   (51)  YEVSKRPSGVSSRFSGSKSGNTASLTISGLQAEDQADYHCCSYAGSGTLL
  BLX-2E9-lambda   (51)  YEVSKRPSGVSSRFSGSKSGNTASLTISGLQAEDQADYHCCSYAGSGTLL
  BLX-3F4-lambda   (51)  YEVSKRPSGVSSRFSGSKSGNTASLTISGLQAEDQADYHCCSYAGSGTLL
  BLX-3G8-lambda   (51)  YEVSKRPSGVSSRFSGSKSGNTASLTISGLQAEDQADYHCCSYAGSGTLL
  IGLV2-23*02_Homo (51)  YEVSKRPSGVSNRFSGSKSGNTASLTISGLQAEDEADYYCCSYAGSSTF-
                              CDR2                                CDR3

101
  BLW-2B4-lambda  (101)  FGGGTKLTVL
  BLW-3B4-lambda  (101)  FGGGTKLTVL
  BLX-1F8-lambda  (101)  FGGGTKLTVL
  BLW-2E6-lambda  (101)  FGGGTKLTVL
  BLX-2E9-lambda  (101)  FGGGTKLTVL
  BLX-3F4-lambda  (101)  FGGGTKLTVL
  BLX-3G8-lambda  (101)  FGGGTKLTVL
  IGLV2-23*02_Homo(100)  ----------
```

Overall structure of PSMM84 Fab bound to PSMA

Fig. 28

Epitope residues of PSMM84

```
humanPSMA  (1)   MWNLLHETDSAVATARRPRWLCAGALVLAG-GFFLLGFLFGWFIKSSNEAT-NITPKHNMKAFLDELKAENIKKFLYNFTQIPHLAGTEQNFQL
mousePSMA  (1)   MWNALQDRDSAEVLGHRQRWLRVGTLVLALTGTFLIGFLFGWFIKPSNEATGNVSHSGMKKEFLHELKAENIKKFLYNFTRTPHLAGTQNNFEL
cynoPSMA   (1)   MWNLLHETDSAVATARRPRWLCAGALVLAG-GFFLLGFLFGWFIKSSSEAT-NITPKHNMKAFLDELKAENIKKFLHNFTQIPHLAGTEQNFQL humanPSMA  (93)  AKQIQSQWKEFGLDSVELAHYDVLLSYPNKTHPNYISIINEDGNEIFNTSLFEPPPGYENVSDIVPPFSAFSPQGMPEGDLVYVNYARTEDFF
mousePSMA  (95)  AKQIHDQWKEFGLDLVELSHYDVLLSYPNKTHPNYISIINEDGNEIFKTSLSEQPPGYENISDVVPPYSAFSPQGTPEGDLVYVNYARTEDFF
cynoPSMA   (93)  AKQIQSQWKEFGLDSVELTHYDVLLSYPNKTHPNYISIINEDGNEIFNTSLFEPPAGYENVSDIVPPFSAFSPQGMPEGDLVYVNYARTEDFF humanPSMA  (187) KLERDMKINCSGKIVIARYGKVFRGNKVKNAQLAGAKGVILYSDPADYFAPGVKSYPDGWNLPGGGVQRGNILNLNGAGDPLTPGYPANEYAYR
mousePSMA  (189) KLEREMKISCSGKIVIARYGKVFRGNMVKNAQLAGAKGMILYSDPADYFVPAVKSYPDGWNLPGGGVQRGNVLNLNGAGDPLTPGYPANEHAYR
cynoPSMA   (187) KLERDMKINCSGKIVIARYGKVFRGNKVKNAQLAGATGVILYSDPDDYFAPGVKIYNVGPFTGNFSTQKVKMHIHSTNEVTRIYNVIGTLRGAVEPDRYVIL humanPSMA  (281) RGIAEAVGLPSIPVHPIGYYDAQKLLEKMGGSAPPDSSWRGSIKVTPYNVGPFTGNFSTQKVKMHIHSTNEVTRIYNVIGTLRGAVEPDRYVIL
mousePSMA  (283) HELTNAVGLPSIPVHPIGYYDAQKLLEHMGGPAPPDSSWKGGIKVTPYNVGPFAGNFSTQKVKMHIHSYTKVTRIYNVIGTLKGALEPDRYVIL
cynoPSMA   (281) RGMAEAVGLPSIPVHPIGYYDAQKLLEKMGGSASPDSSWRGSIKVTPYNVGPFTGNFSTQKVKMHIHSTSEVTRIYNVIGTLRGAVEPDRYVIL humanPSMA  (375) GGHRDSWVFGGIDPQSGAAVVHEIVRSFGTLKKEGWRPRRTILFASWDAEEFGLLGSTEWAEENSRLLQERGVAYINADSSIEGNYTLRVDCTP
mousePSMA  (377) GGHRDAWVFGGIDPQSGAAVVHEIVRSFGTLKKGRRPRRTILFASWDAEEFGLLGSTEWAEEHSRLLQERGVAYINADSSIEGNYTLRVDCTP
cynoPSMA   (375) GGHRDSWVFGGIDPQSGAAVVHEIVRSFGMLKKEGWRPRRTILFASWDAEEFGLLGSTEWAEENSRLLQERGVAYINADSSIEGNYTLRVDCTP humanPSMA  (469) LMYSLVHNLTKELKSPDEGFEGKSLYESWTKKSPSPEFSGMPRISKLGSGNDFEVFFQRLGIASGRARYTKNWETNKFSGYPLYHSVYETYELV
mousePSMA  (471) LMYSLVYNLTKELQSPDEGFEGKSLYDSWKEKSPSPEFIGMPRISKLGSGNDFEVFFQRLGIASGRARYTKNWKTNKVSSYPLYHSVYETYELV
cynoPSMA   (469) LMYSLVYNLTKELESPDEGFEGKSLYESWTKKSPSPEFSGMPRISKLGSGNDFEVFFQRLGIASGRARYTKNWETNKFSSYPLYHSVYETYELV humanPSMA  (563) EKFYDPMFKYHLTVAQVRGGMVFELANSIVLPFDCRDYAVVLRKYADKIYSISMKHPQEMKTYSVSFDSLFSAVKNFTEIASKFSERLQDFDKS
mousePSMA  (565) VKFYDPTFKYHLTVAQVRGAMVFELANSVVLPFDCQSYAVALKKYADTIYNISMKHPQEMKAYMISFDSLFSAVNNFTDVASKFNQRLQELDKS
cynoPSMA   (563) EKFYDPMFKYHLTVAQVRGGMVFELANSVVLPFDCRDYAVVLRKYADKIYNISMKHPQEMKTYSVSFDSLFSAVKNFTEIASKFSERLRDFDKS humanPSMA  (657) NPIVLRMMNDQLMFLERAFIDPLGLPDRPFYRHVIYAPSSHNKYAGESFPGIYDALFDIESKVDPSKAWGEVKRQIYVAAFTVQAAAETLSEVA
mousePSMA  (659) NPILLRIMNDQLMYLERAFIDPLGLPGRPFYRHIIYAPSSHNKYAGESFPGIYDALFDISSKVNASKAWNEVKRQISIATFTVQAAAETLREVA
cynoPSMA   (657) NPILLRMMNDQLMFLERAFIDPLGLPDRPFYRHVIYAPSSHNKYAGESFPGIYDALFDIESKVDPSQAWGEVKRQISIATFTVQAAAETLSEVA
```

Epitope residues are shaded. Sequence divergence shown by underline.

Fig. 29

Paratope residues of PSMM84

Paratope of PSMM84

PSMM84_HC   (1)   EVQLLESGGGLVQPGGSLRLSCAASGFTFKSDAMHWVRQAPGKGLEWVSEISGSG<u>GYTNYADSVKG</u>RFTISRDNSK
PSMM84_HC  (77)   NTLYLQMNSLRAEDTAVYYCARDS<u>YDSSLYVGD</u>YFDYWGQGTLVTVSSASTKGPSVFPLAPSSKSTSGGTAALGCL
PSMM84_HC (153)   VKDYFPEPVTVSWNSGALTSGVHTFPAVLQSSGLYSLSSVVTVPSSSLGTQTYICNVNHKPSNTKVDKKVEPKSC

PSMM84_LC   (1)   EIVLTQSPATLSLSPGERATLSCRASQSV<u>SSY</u>LAWYQQKPGQAPRLLIYDASNRATGIPARFSGSGSGTDFT
PSMM84_LC  (73)   LTISSLEPEDFAVYYCQQ<u>RSNW</u>PLTFGQGTKVEIKRTVAAPSVFIFPPSDEQLKSGTASVVCLLNNFYPREA
PSMM84_LC (145)   KVQWKVDNALQSGNSQESVTEQDSKDSTYSLSSTLTLSKADYEKHKVYACEVTHQGLSSPVTKSFNRGEC

CDR regions underlined. Paratope residues shaded.

|  | Difference | Sigma | p-value |
|---|---|---|---|
| Difference at 0.01 | -0.414 | 0.553 | 0.9439 |
| Difference at 0.03 | -0.718 | 0.553 | 0.5723 |
| Difference at 0.1 | -0.537 | 0.553 | 0.8182 |
| Difference at 0.3 | -1.227 | 0.553 | 0.1172 |
| Difference at 1 | -1.547 | 0.553 | 0.0281 |
| Difference at 3 | -0.875 | 0.553 | 0.3817 |
| Difference at 10 | -0.248 | 0.553 | 0.9983 |
| Difference at 30 | -0.164 | 0.553 | 0.9999 |
| Difference at 100 | -0.348 | 0.553 | 0.9797 |
| Difference at 300 | -0.281 | 0.553 | 0.9955 |

|  | JNJ819 (IC3B19) | JNJ310 (IC3B34) | p-value |
|---|---|---|---|
| EC50 | 0.940 (0.682, 1.295) | 1.763 (1.381, 2.252) | 0.0027 |
| Slope | 0.710 (0.423, 0.996) | 0.540 (0.335, 0.744) | 0.3046 |
| Minimum | 3.119 (2.769, 3.469) | 2.592 (2.309, 2.875) | 0.0268 |
| Maximum | 7.589 (6.865, 8.313) | 7.335 (6.613, 8.058) | 0.2033 |

|  | Difference | Sigma | p-value |
|---|---|---|---|
| Difference at 0.01 | -0.431 | 0.618 | 0.9976 |
| Difference at 0.03 | -0.183 | 0.618 | 1.0000 |
| Difference at 0.1 | -0.321 | 0.618 | 0.9998 |
| Difference at 0.3 | -1.020 | 0.618 | 0.5913 |
| Difference at 1 | -2.105 | 0.618 | 0.0064 |
| Difference at 3 | -1.508 | 0.618 | 0.1255 |
| Difference at 10 | -0.806 | 0.618 | 0.8424 |
| Difference at 30 | -0.624 | 0.618 | 0.9635 |
| Difference at 100 | -0.556 | 0.618 | 0.9834 |
| Difference at 300 | -0.049 | 0.618 | 1.0000 |

|  | JNJ819 (IC3B19) | JNJ310 (IC3B34) | p-value |
|---|---|---|---|
| EC50 | 1.060 (0.798, 1.408) | 2.068 (1.587, 2.695) | 0.0010 |
| Slope | 0.512 (0.230, 0.794) | 0.365 (0.173, 0.557) | 0.3951 |
| Minimum | 1.254 (0.818, 1.690) | 0.905 (0.525, 1.286) | 0.2543 |
| Maximum | 6.798 (6.117, 7.478) | 6.268 (5.589, 6.947) | 0.0528 |

|  | Difference | Sigma | p-value |
|---|---|---|---|
| Difference at 0.01 | -0.105 | 0.599 | 1.0000 |
| Difference at 0.03 | 0.704 | 0.599 | 0.8315 |
| Difference at 0.1 | 0.198 | 0.599 | 1.0000 |
| Difference at 0.3 | -0.841 | 0.599 | 0.6679 |
| Difference at 1 | -2.095 | 0.599 | 0.0041 |
| Difference at 3 | -0.330 | 0.599 | 0.9989 |
| Difference at 10 | -0.382 | 0.599 | 0.9963 |
| Difference at 30 | 0.026 | 0.599 | 1.0000 |
| Difference at 100 | 0.222 | 0.599 | 1.0000 |
| Difference at 300 | 0.568 | 0.599 | 0.9440 |

|  | JNJ819 (IC3B19) | JNJ310 (IC3B34) | p-value |
|---|---|---|---|
| EC50 | 1.063 (0.829, 1.361) | 2.044 (1.697, 2.463) | 0.0001 |
| Slope | 0.665 (0.440, 0.890) | 0.383 (0.247, 0.520) | 0.0256 |
| Minimum | 1.038 (0.613, 1.463) | 1.311 (0.973, 1.650) | 0.3103 |
| Maximum | 8.053 (7.398, 8.707) | 8.168 (7.527, 8.809) | 0.6466 |

|  | Difference | Sigma | p-value |
|---|---|---|---|
| Difference at 0.01 | 0.928 | 0.676 | 0.8169 |
| Difference at 0.03 | 0.859 | 0.676 | 0.8755 |
| Difference at 0.1 | 0.737 | 0.676 | 0.9485 |
| Difference at 0.3 | -0.567 | 0.676 | 0.9917 |
| Difference at 1 | -1.950 | 0.676 | 0.0370 |
| Difference at 3 | 0.372 | 0.676 | 0.9998 |
| Difference at 10 | 0.954 | 0.676 | 0.7914 |
| Difference at 30 | 0.987 | 0.676 | 0.7576 |
| Difference at 100 | 1.066 | 0.676 | 0.6693 |
| Difference at 300 | 1.488 | 0.676 | 0.2289 |

|  | JNJ819 (IC3B19) | JNJ310 (IC3B34) | p-value |
|---|---|---|---|
| EC50 | 0.558 (0.380, 0.821) | 1.611 (1.199, 2.166) | Sig. |
| Slope | 0.554 (0.256, 0.851) | 0.353 (0.168, 0.539) | 0.2079 |
| Minimum | 1.231 (0.638, 1.824) | 2.129 (1.674, 2.584) | 0.0158 |
| Maximum | 6.874 (6.327, 7.421) | 7.988 (7.425, 8.551) | 0.0008 |

|  | Difference | Sigma | p-value |
|---|---|---|---|
| Difference at 0.01 | -0.010 | 0.301 | 1.0000 |
| Difference at 0.03 | 0.563 | 0.301 | 0.3761 |
| Difference at 0.1 | 0.110 | 0.301 | 1.0000 |
| Difference at 0.3 | -0.361 | 0.301 | 0.8592 |
| Difference at 3 | 0.081 | 0.301 | 1.0000 |
| Difference at 10 | 0.253 | 0.301 | 0.9815 |
| Difference at 30 | 0.439 | 0.301 | 0.6850 |
| Difference at 100 | 0.780 | 0.301 | 0.0749 |
| Difference at 300 | 1.031 | 0.301 | 0.0054 |

|  | Difference | Sigma | p-value |
|---|---|---|---|
| Difference at 0.01 | -0.756 | 0.474 | 0.6568 |
| Difference at 0.03 | -0.882 | 0.474 | 0.4482 |
| Difference at 0.1 | -0.795 | 0.474 | 0.5915 |
| Difference at 0.3 | -1.337 | 0.474 | 0.0454 |
| Difference at 1 | -3.54 | 0.474 | <0.0001 |
| Difference at 3 | -1.786 | 0.474 | 0.0016 |
| Difference at 10 | -1.504 | 0.474 | 0.0146 |
| Difference at 30 | -1.329 | 0.474 | 0.0475 |
| Difference at 100 | -1.043 | 0.474 | 0.2301 |
| Difference at 300 | -0.831 | 0.474 | 0.5305 |

|  | Difference | Sigma | p-value |
|---|---|---|---|
| Difference at 0.01 | 0.263 | 0.456 | 0.9990 |
| Difference at 0.03 | 0.302 | 0.456 | 0.9970 |
| Difference at 0.1 | 0.304 | 0.456 | 0.9968 |
| Difference at 0.3 | -0.367 | 0.456 | 0.9866 |
| Difference at 1 | -0.962 | 0.456 | 0.2340 |
| Difference at 3 | -0.059 | 0.456 | 1.0000 |
| Difference at 10 | -0.037 | 0.456 | 1.0000 |
| Difference at 30 | 0.056 | 0.456 | 1.0000 |
| Difference at 100 | 0.156 | 0.456 | 1.0000 |
| Difference at 300 | 0.314 | 0.456 | 0.9958 |

|  | JNJ819 (IC3B19) | JNJ310 (IC3B34) | p-value |
|---|---|---|---|
| EC50 | 0.821 (0.549, 1.229) | 1.796 (1.320, 2.444) | Sig. |
| Slope | 0.678 (0.324, 1.031) | 0.349 (0.162, 0.536) | 0.0819 |
| Minimum | 3.917 (3.582, 4.252) | 4.243 (3.993, 4.493) | 0.1151 |
| Maximum | 7.221 (6.742, 7.700) | 7.337 (6.865, 7.808) | 0.5224 |

|  | Difference | Sigma | p-value |
|---|---|---|---|
| Difference at 0.01 | -0.948 | 0.698 | 0.8438 |
| Difference at 0.03 | -0.875 | 0.698 | 0.8982 |
| Difference at 0.1 | -1.071 | 0.698 | 0.7261 |
| Difference at 0.3 | -0.811 | 0.698 | 0.9349 |
| Difference at 1 | -1.724 | 0.698 | 0.1254 |
| Difference at 3 | -0.090 | 0.698 | 1.0000 |
| Difference at 10 | 0.207 | 0.698 | 1.0000 |
| Difference at 30 | -0.061 | 0.698 | 1.0000 |
| Difference at 100 | -0.001 | 0.698 | 1.0000 |
| Difference at 300 | -1.001 | 0.698 | 0.7966 |

|  | Difference | Sigma | p-value |
|---|---|---|---|
| Difference at 0.01 | -0.285 | 0.560 | 0.9985 |
| Difference at 0.03 | -0.349 | 0.560 | 0.9927 |
| Difference at 0.1 | -0.512 | 0.560 | 0.9192 |
| Difference at 0.3 | -0.299 | 0.560 | 0.9977 |
| Difference at 1 | -1.276 | 0.576 | 0.1433 |
| Difference at 3 | -0.311 | 0.621 | 0.9986 |
| Difference at 10 | 0.158 | 0.649 | 1.0000 |
| Difference at 30 | 0.062 | 0.649 | 1.0000 |
| Difference at 100 | 0.259 | 0.649 | 0.9998 |
| Difference at 300 | 0.386 | 0.649 | 0.9948 |

|  | Difference | Sigma | p-value |
|---|---|---|---|
| Difference at 0.01 | -2.073 | 1.303 | 0.3365 |
| Difference at 0.03 | -2.198 | 1.303 | 0.2873 |
| Difference at 0.1 | -1.972 | 1.303 | 0.3811 |
| Difference at 0.3 | -2.753 | 1.309 | 0.1302 |
| Difference at 1 | -2.650 | 1.309 | 0.1533 |
| Difference at 3 | -0.834 | 1.419 | 0.9715 |
| Difference at 10 | -0.880 | 1.551 | 0.9766 |
| Difference at 30 | -0.819 | 1.551 | 0.9847 |
| Difference at 100 | -1.189 | 1.551 | 0.8961 |
| Difference at 300 | -1.909 | 1.445 | 0.5029 |

| | Difference | Sigma | p-value |
|---|---|---|---|
| Difference at 0.01 | 0.098 | 0.325 | 1.0000 |
| Difference at 0.03 | -0.077 | 0.325 | 1.0000 |
| Difference at 0.1 | 0.127 | 0.325 | 1.0000 |
| Difference at 0.3 | -0.963 | 0.325 | 0.0293 |
| Difference at 1 | -2.09 | 0.325 | <0.0001 |
| Difference at 3 | -0.026 | 0.325 | 1.0000 |
| Difference at 10 | -0.037 | 0.325 | 1.0000 |
| Difference at 30 | -0.245 | 0.325 | 0.9967 |
| Difference at 100 | 0.098 | 0.325 | 1.0000 |
| Difference at 300 | 0.375 | 0.325 | 0.9308 |

|  | JNJ819 (IC3B19) | JNJ310 (IC3B34) | p-value |
|---|---|---|---|
| EC50 | 0.844 (0.698, 1.021) | 1.718 (1.500, 1.968) | <0.0001 |
| Slope | 0.724 (0.557, 0.892) | 0.421 (0.325, 0.517) | 0.0010 |
| Minimum | 1.067 (0.775, 1.359) | 1.237 (1.020, 1.453) | 0.3406 |
| Maximum | 7.353 (7.070, 7.636) | 7.413 (7.140, 7.686) | 0.7036 |

|  | Difference | Sigma | p-value |
|---|---|---|---|
| Difference at 0.01 | -1.404 | 0.583 | 0.1405 |
| Difference at 0.03 | -1.391 | 0.583 | 0.1484 |
| Difference at 0.1 | -1.472 | 0.583 | 0.1043 |
| Difference at 0.3 | -2.546 | 0.583 | 1e-04 |
| Difference at 1 | -3.33 | 0.583 | <0.0001 |
| Difference at 3 | -1.693 | 0.583 | 0.0352 |
| Difference at 10 | -0.98 | 0.583 | 0.5852 |
| Difference at 30 | -1.011 | 0.583 | 0.5434 |
| Difference at 100 | -0.898 | 0.583 | 0.6952 |
| Difference at 300 | -0.956 | 0.583 | 0.6178 |

|  | JNJ819 (IC3B19) | JNJ310 (IC3B34) | p-value |
|---|---|---|---|
| EC50 | 0.503 (0.362, 0.697) | 1.263 (1.000, 1.595) | <0.0001 |
| Slope | 0.607 (0.344, 0.870) | 0.425 (0.206, 0.644) | 0.2702 |
| Minimum | 1.006 (0.471, 1.540) | -0.192 (-0.599, 0.214) | 0.0011 |
| Maximum | 6.999 (6.459, 7.539) | 6.004 (5.453, 6.554) | 0.0004 |

|  | Difference | Sigma | p-value |
|---|---|---|---|
| Difference at 0.01 | 0.096 | 0.485 | 1.0000 |
| Difference at 0.03 | 0.081 | 0.485 | 1.0000 |
| Difference at 0.1 | 0.351 | 0.485 | 0.9953 |
| Difference at 0.3 | 0.002 | 0.485 | 1.0000 |
| Difference at 1 | -0.302 | 0.485 | 0.9986 |
| Difference at 3 | 0.369 | 0.485 | 0.9931 |
| Difference at 10 | 0.216 | 0.485 | 0.9999 |
| Difference at 30 | 0.792 | 0.485 | 0.5672 |
| Difference at 100 | 0.814 | 0.485 | 0.5321 |
| Difference at 300 | 2.024 | 0.485 | 0.0003 |

|  | Difference | Sigma | p-value |
|---|---|---|---|
| Difference at 0.01 | -0.140 | 0.503 | 1.0000 |
| Difference at 0.03 | 0.108 | 0.503 | 1.0000 |
| Difference at 0.1 | -0.022 | 0.503 | 1.0000 |
| Difference at 0.3 | 0.324 | 0.503 | 0.9988 |
| Difference at 1 | -0.822 | 0.503 | 0.6083 |
| Difference at 3 | 0.623 | 0.503 | 0.8814 |
| Difference at 10 | -0.059 | 0.503 | 1.0000 |
| Difference at 30 | -0.022 | 0.503 | 1.0000 |
| Difference at 100 | 0.178 | 0.503 | 1.0000 |
| Difference at 300 | 0.718 | 0.503 | 0.7659 |

|  | Difference | Sigma | p-value |
|---|---|---|---|
| Difference at 0.01 | 0.307 | 0.312 | 0.8941 |
| Difference at 0.03 | 0.108 | 0.312 | 1.0000 |
| Difference at 0.1 | 0.161 | 0.312 | 0.9985 |
| Difference at 0.3 | -0.170 | 0.312 | 0.9978 |
| Difference at 1 | -0.817 | 0.312 | 0.0565 |
| Difference at 3 | 0.071 | 0.312 | 1.0000 |
| Difference at 10 | 0.159 | 0.312 | 0.9987 |
| Difference at 30 | 0.212 | 0.312 | 0.9886 |
| Difference at 100 | 0.393 | 0.312 | 0.7092 |
| Difference at 300 | 0.536 | 0.312 | 0.3785 |

|  | Difference | Sigma | p-value |
|---|---|---|---|
| Difference at 0.01 | -2.735 | 0.49 | <0.0001 |
| Difference at 0.03 | -2.489 | 0.49 | <0.0001 |
| Difference at 0.1 | -2.726 | 0.49 | <0.0001 |
| Difference at 0.3 | -2.846 | 0.49 | <0.0001 |
| Difference at 1 | -3.337 | 0.49 | <0.0001 |
| Difference at 3 | -2.707 | 0.49 | <0.0001 |
| Difference at 10 | -2.132 | 0.49 | 1e-04 |
| Difference at 30 | -2.005 | 0.49 | 4e-04 |
| Difference at 100 | -1.869 | 0.49 | 0.0014 |
| Difference at 300 | -1.753 | 0.49 | 0.0034 |

|  | JNJ819 (IC3B19) | JNJ310 (IC3B34) | p-value |
|---|---|---|---|
| EC50 | 0.731 (0.467, 1.143) | 1.564 (1.111, 2.202) | 0.0106 |
| Slope | 0.651 (0.270, 1.033) | 0.599 (0.300, 0.899) | 0.8268 |
| Minimum | 2.729 (2.341, 3.118) | 0.162 (-0.165, 0.490) | <0.0001 |
| Maximum | 6.077 (5.523, 6.630) | 4.155 (3.590, 4.721) | <0.0001 |

|  | Difference | Sigma | p-value |
|---|---|---|---|
| Difference at 0.01 | 0.220 | 0.927 | 1.0000 |
| Difference at 0.03 | 0.448 | 0.927 | 0.9991 |
| Difference at 0.1 | 0.225 | 0.927 | 1.0000 |
| Difference at 0.3 | -0.735 | 0.927 | 0.9718 |
| Difference at 1 | -1.596 | 0.927 | 0.4007 |
| Difference at 3 | -0.836 | 0.927 | 0.9413 |
| Difference at 10 | -0.060 | 1.123 | 1.0000 |
| Difference at 30 | 0.538 | 1.123 | 0.9992 |
| Difference at 300 | 1.510 | 1.206 | 0.7439 |

|  | JNJ819 (IC3B19) | JNJ310 (IC3B34) | p-value |
|---|---|---|---|
| EC50 | 1.037 (0.693, 1.553) | 2.304 (1.552, 3.420) | 0.0065 |
| Slope | 0.722 (0.358, 1.087) | 0.617 (0.268, 0.966) | 0.6920 |
| Minimum | 4.007 (3.317, 4.697) | 4.335 (3.760, 4.909) | 0.4644 |
| Maximum | 11.258 (10.434, 12.083) | 11.952 (10.597, 13.307) | 0.3179 |

|  | Difference | Sigma | p-value |
|---|---|---|---|
| Difference at 0.01 | 0.576 | 0.699 | 0.9926 |
| Difference at 0.03 | 0.406 | 0.699 | 0.9996 |
| Difference at 0.1 | 0.034 | 0.699 | 1.0000 |
| Difference at 0.3 | -0.329 | 0.699 | 0.9999 |
| Difference at 1 | -1.084 | 0.699 | 0.6880 |
| Difference at 3 | 0.401 | 0.699 | 0.9996 |
| Difference at 10 | 1.056 | 0.869 | 0.9007 |
| Difference at 30 | 0.804 | 0.942 | 0.9903 |
| Difference at 100 | 1.253 | 1.389 | 0.9854 |
| Difference at 300 | -0.082 | 0.922 | 1.0000 |

|  | Difference | Sigma | p-value |
|---|---|---|---|
| Difference at 0.01 | 0.242 | 0.53 | 0.9997 |
| Difference at 0.03 | 0.233 | 0.53 | 0.9998 |
| Difference at 0.1 | 0.203 | 0.53 | 0.9999 |
| Difference at 0.3 | -0.362 | 0.53 | 0.9918 |
| Difference at 1 | -1.258 | 0.53 | 0.1120 |
| Difference at 3 | 0.035 | 0.53 | 1.0000 |
| Difference at 10 | -0.446 | 0.53 | 0.9660 |
| Difference at 30 | -0.175 | 0.53 | 1.0000 |
| Difference at 100 | -0.058 | 0.53 | 1.0000 |
| Difference at 300 | 0.521 | 0.53 | 0.9172 |

|  | JNJ819 (IC3B19) | JNJ310 (IC3B34) | p-value |
|---|---|---|---|
| EC50 | 1.260 (1.022, 1.555) | 1.952 (1.658, 2.298) | 0.0016 |
| Slope | 0.686 (0.495, 0.876) | 0.405 (0.287, 0.523) | 0.0128 |
| Minimum | 3.151 (2.860, 3.441) | 3.425 (3.187, 3.663) | 0.1443 |
| Maximum | 9.019 (8.263, 9.775) | 8.973 (8.226, 9.720) | 0.7895 |

|  | Difference | Sigma | p-value |
|---|---|---|---|
| Difference at 0.01 | -1.21 | 0.579 | 0.2840 |
| Difference at 0.03 | -1.099 | 0.579 | 0.4088 |
| Difference at 0.1 | -1.365 | 0.579 | 0.1560 |
| Difference at 0.3 | -1.471 | 0.579 | 0.0982 |
| Difference at 1 | -2.66 | 0.579 | <0.0001 |
| Difference at 3 | -0.718 | 0.579 | 0.8826 |
| Difference at 10 | -0.497 | 0.579 | 0.9889 |
| Difference at 30 | -0.245 | 0.579 | 1.0000 |
| Difference at 100 | 0.243 | 0.579 | 1.0000 |
| Difference at 300 | -0.33 | 0.579 | 0.9996 |

|  | JNJ819 (IC3B19) | JNJ310 (IC3B34) | p-value |
|---|---|---|---|
| EC50 | 0.546 (0.344, 0.866) | 1.530 (1.122, 2.087) | 0.0004 |
| Slope | 0.558 (0.202, 0.915) | 0.433 (0.197, 0.668) | 0.5553 |
| Minimum | 3.116 (2.628, 3.604) | 2.083 (1.699, 2.467) | 0.0043 |
| Maximum | 6.973 (6.431, 7.515) | 6.807 (6.248, 7.365) | 0.5216 |

|  | IL1RAP Affinity (nM) | Cytotox EC$_{50}$ (nM) |
|---|---|---|
| JNJ-63960819 | 0.04 | 0.018 |
| JNJ-67507310 | 0.02 | 0.057 |

Fig. 69

```
25      EVQLLESGGGLVQR-GGSLRPSCAASGFTFS
27      EVQLLESGGGLVQPPGGSLRLSCAASGFTFS
87      EVQLLESGGGLVQP-GGSLRLSCAASGFTFS
89      EVQLLESGGGLVQP-GGSLRLSCAASGFTFS
        ************  ***** **********

25      SYSMSWVRQAPGKGLEWVSVISGSGGFTDY
27      SYSMSWVRQAPGKGLEWVSVISGGGSFTSY
87      SYSMSWVRQAPGKGLEWVSVISGSGGFTDY
89      SYSMSWVRQAPGKGLEWVSVISGSGGFTDY
        *********************.*.**.*

25      ADSVKGRFTISRDNSKNTLYLHMNSLRAED
27      ADSVKGRFTISRDNSNNTLYLQMSSLRAED
87      ADSVKGRFTISRDNSKNTLYLQMNSLRAED
89      ADSVKGRFTISRDNSKNTLYLHMNSLRAED
        ***************:*****:*.******

25      TAVYYCARMPLNSPHDYWGQGTLVTVSS
27      TAFYYCARMPLNSPHDCWGQGTLVTVSS
87      TAVYYCARMPLNSPHDYWGQGTLVTVSS
89      TAVYYCARMPLNSPHDYWGQGTLVTVSS
        **.************ ************
```

Fig. 70

```
28    AIQMTQSPSSLSASVGDRVTITCRASQGIR
30    AIQMTQSPSSLSASVGDRVTITCRASQGIR
88    DIQMTQSPSSLSASVGDRVTITCRASQGIR
90    AIQMTQSPSSLSASVGDRVTITCRASQGIR
       *****************************

28    NDLGWYQQKPGKAPKLLIYAASSLQSGVPS
30    NDLGWYQQKPGKAPKLLIYAASSLQSGVPS
88    NDLGWYQQKPGKAPKLLIYAASSLQSGVPS
90    NDLGWYQQKPGKAPKLLIYAASSLQSGVPS
       ******************************

28    RFSGSGSGTDFTLTISSLQPEDFATYYCLQ
30    RFSGSGSGTDFTLTISSLQPEDFATYYCLQ
88    RFSGSGSGTDFTLTISSLQPEDFATYYCLQ
90    RFSGSGSGTDFTLTISSLQPEDFATYYCLQ
       ******************************

28    DYNYALTFGGGTKVEIK
30    DYNYSLTFGGGTKVEIR
88    DYNYPLTFGGGTKVEIK
90    DYNYPLTFGGGTKVEIK
       ****.***********:
```

*p≤ 0.0001 for treatment vs. control, calculated by the Linear Mixed-Effects analysis followed by pairwise comparisons. Bar below the X-axis represents the dosing period.

ANTI-CD3 ANTIBODIES AND USES THEREOF

SEQUENCE LISTING

The instant application contains a Sequence Listing which has been submitted electronically in ASCII format and is hereby incorporated by reference in its entirety. Said ASCII copy, created on Aug. 11, 2021, is named JBI5135USNP1SequenceListingAmended.txt and is 593 KB in size.

TECHNICAL FIELD

The disclosure provided herein relates to anti-cluster of differentiation 3 (CD3)-antibodies, and antigen-binding fragments thereof, capable of specifically binding to human and non-human CD3, and in particular to anti-CD3 antibodies and antigen-binding fragments that are cross-reactive with CD3 of a non-human mammal (e.g., a cynomolgus monkey); prostate specific membrane antigen (PSMA)-antibodies, and antigen-binding fragments thereof, capable of specifically binding to human and non-human PSMA; IL1RAP antibodies, and antigen-binding fragments thereof, capable of specifically binding to human and non-human IL1RAP; CD33 antibodies, and antigen-binding fragments thereof, capable of specifically binding to human and non-human CD33; and bispecific antibodies that are capable of specifically binding CD3; PSMA; IL1RAP; CD33; CD3 and PSMA; CD3 and IL1RAP; or CD3 and CD33. The disclosure also pertains to uses of such antibodies and antigen-binding fragments in the treatment of cancer, autoimmune and/or inflammatory diseases and other conditions.

BACKGROUND

Bispecific antibodies and antibody fragments have been explored as a means to recruit cytolytic T cells to kill tumor cells. However, the clinical use of many T cell-recruiting bispecific antibodies has been limited by challenges including unfavorable pharmacokinetics, potential immunogenicity, and manufacturing issues. There thus exists a considerable need for bispecific antibodies that recruit cytolytic T cells to kill tumor cells that exhibit reduced toxicity and favorable manufacturing profiles.

The human CD3 T cell antigen receptor protein complex is composed of six distinct chains: a CD3γ chain (SwissProt P09693), a CD3δ chain (SwissProt P04234), two CD3ε chains (SwissProt P07766), and one CD3ζ chain homodimer (SwissProt P20963) (ε γ: ε δ:ζζ), which is associated with the T cell receptor α and β chain. This complex plays an important role in coupling antigen recognition to several intracellular signal-transduction pathways. The CD3 complex mediates signal transduction, resulting in T cell activation and proliferation. CD3 is required for immune response.

SUMMARY

Provided herein are isolated recombinant anti-CD3 antibodies, or antigen-binding fragments thereof, comprising: a heavy chain comprising a heavy chain complementarity determining region (HCDR) 1 comprising SEQ ID NO: 662; a HCDR2 comprising SEQ ID NO: 663; and a HCDR3 comprising SEQ ID NO: 664 and a light chain comprising a light chain complementarity determining region (LCDR) 1 comprising SEQ ID NO: 671, a LCDR2 comprising SEQ ID NO: 673, and a LCDR3 comprising SEQ ID NO: 690; a heavy chain variable region comprising SEQ ID NO: 652 and a light chain variable region comprising SEQ ID NO: 661; a heavy chain comprising SEQ ID NO: 640 and a light chain comprising SEQ ID NO: 676; or comprising: a heavy chain comprising a HCDR1 comprising SEQ ID NO: 662; a HCDR2 comprising SEQ ID NO: 663; and a HCDR3 comprising SEQ ID NO: 664 and a light chain comprising a LCDR1 comprising SEQ ID NO: 773, a LCDR2 comprising SEQ ID NO: 673, and a LCDR3 comprising SEQ ID NO: 690; a heavy chain variable region comprising SEQ ID NO: 657 and a light chain variable region comprising SEQ ID NO: 678; or a heavy chain comprising SEQ ID NO: 675 and a light chain comprising SEQ ID NO: 678.

Also provided are isolated recombinant anti-CD3 antibodies or antigen-binding fragments thereof, that specifically bind *Macaca fascicularis* or human CD3d, or CD3e, or CD3e and CD3d with a binding affinity of about 300 nM or less.

In some embodiments, the isolated recombinant anti-CD3 antibodies or antigen-binding fragments thereof have one, two, three, or four, of the following properties:

bind human and *Macaca fascicularis* CD3+T lymphocytes with a calculated EC50 of 20 nM or less and bind *Macaca fascicularis* CD3-expressing HEK cells with a calculated EC50 of 40 nM or less, wherein the difference in calculated EC50 between binding CD3+T lymphocytes and binding *Macaca fascicularis* CD3-expressing HEK cells is less than 5-fold, and wherein the calculated EC50 is measured in a whole cell binding assay at 0° C. using flow cytometry;

bind recombinant CD3d from human (SEQ ID NO:691), or bind recombinant CD3e from human (SEQ ID NO:636), or recombinant CD3d from *Macaca fascicularis* (SEQ ID NO:692), with an equilibrium dissociation constant (KD) of 12 nM or less, wherein the KD is measured using Proteon surface plasmon resonance assay ProteOn XPR36 system at +25° C.;

bind residues 1-6 of CD3e as determined by X-ray crystallography; or activate T cells or induces CD69 expression to a similar degree as cOKT3 or SP34-2 as determined by fluorescence-activated cell sorting assay.

In some embodiments, the antibodies or antigen-binding fragments thereof described herein comprise the HCDR1, the HCDR2, the HCDR3, the LCDR1, the LCDR2, and the LCDR3 of SEQ ID NOs:662, 663, 664, 671, 673, and 690, respectively; a VH and a VL of SEQ ID NOs:652 and 661, respectively; or a HC and a LC of SEQ ID NOs:640 and 676, respectively.

In some embodiments, the antibodies or antigen-binding fragments thereof described herein comprise the HCDR1, the HCDR2, the HCDR3, the LCDR1, the LCDR2, and the LCDR3 of SEQ ID NOs:662, 663, 664, 773, 673, and 690, respectively; a VH and a VL of SEQ ID NOs:657 and 678, respectively or a HC and a LC of SEQ ID NOs:675 and 677, respectively.

Further described herein are bispecific antibodies comprising a first domain that specifically binds CD3 and a second domain that specifically binds a second antigen, wherein the first domain comprises an antibody or antigen-binding fragment thereof described herein.

The bispecific antibodies described herein can comprise a first domain that comprises the HCDR1, HCDR2, HCDR3, the LCDR1, the LCDR2, and the LCDR3 of SEQ ID NOs:662, 663, 664, 671, 673, and 670, respectively; and a second domain that comprises the HCDR1, HCDR2, the HCDR3, the LCDR1, the LCDR2, and the LCDR3 of SEQ ID NOs:697, 683, 698, 699, 792, and 686, respectively;

The bispecific antibodies described herein can comprise a first domain that comprises the VH and VL of SEQ ID NOs:652 and 661, respectively; and a second domain that comprises the VH and VL of SEQ ID NOs:681 and 682, respectively.

The bispecific antibodies described herein can comprise a first domain that comprises the HC and LC of SEQ ID NOs:640 and 676, respectively; and a second domain that comprises the HC and LC of SEQ ID NOs:679 and 680, respectively.

The bispecific antibodies described herein can comprise a first domain that comprises the HCDR1, HCDR2, the HCDR3, the LCDR1, the LCDR2, and the LCDR3 of SEQ ID NOs:662, 663, 664, 671, 673, and 670, respectively; and a second domain that comprises the HCDR1, HCDR2, the HCDR3, the LCDR1, the LCDR2, and the LCDR3 of SEQ ID NOs:704, 705, 706, 707, 708, and 709, respectively.

The bispecific antibodies described herein can comprise a first domain that comprises the VH and VL of SEQ ID NOs:652 and 661, respectively; and a second domain that comprises the VH and VL of SEQ ID NOs:702 and 703, respectively.

The bispecific antibodies described herein can comprise a first domain that comprises the HC and LC of SEQ ID NOs:640 and 676, respectively; and a second domain that comprises the HC and LC of SEQ ID NOs:700 and 701, respectively.

The disclosure further provides isolated bispecific CD3×PSMA antibodies comprising a first domain that binds to cells expressing recombinant *Macaca fascicularis* or human CD3d or CD3e with an affinity of 300 nM or less, wherein the binding to cells is measured by flow cytometry, and a second domain that specifically bind PSMA.

In some embodiments, the bispecific CD3×PSMA antibody comprises a first domain that:
  binds human and *Macaca fascicularis* CD3+T lymphocytes with a calculated EC50 of 20 nM or less and binds *Macaca fascicularis* CD3-expressing HEK cells with a calculated EC50 of 40 nM or less, wherein the difference in calculated EC50 between binding CD3+T lymphocytes and binding *Macaca fascicularis* CD3-expressing HEK cells is less than 5-fold, and wherein the calculated EC50 is measured in a whole cell binding assay at 0° C. using flow cytometry;
  binds recombinant CD3d from human (SEQ ID NO:691), or binds recombinant CD3e from human (SEQ ID NO:636), or binds recombinant CD3d from *Macaca fascicularis* (SEQ ID NO:692), or binds recombinant CD3e from *Macaca fascicularis* (SEQ ID NO:693) with an equilibrium dissociation constant (KD) of 12 nM or less, wherein the KD is measured using Proteon surface plasmon resonance assay ProteOn XPR36 system at +25° C.;
  displays no methionine or tryptophan oxidation, or displays no asparagine deamidation, or displays no asparagine isomerization as detected by peptide mapping analysis;
  binds residues 1-6 of CD3e as determined by X-ray crystallography; or
  activates T cells or induces CD69 expression to a similar degree as cOKT3 or SP34-2 as determined by fluorescence-activated cell sorting assay.

Also described are pharmaceutical compositions comprising the antibodies described herein and a pharmaceutically acceptable carrier.

The disclosure further provides methods of producing the antibodies described herein, comprising culturing a host cell comprising a vector comprising a polynucleotide encoding the antibodies or antigen-binding fragments thereof described herein in conditions that the antibody is expressed, and recovering the antibody produced by the host cell. The methods of producing the bispecific CD3×PSMA antibody can comprise combining a monospecific bivalent CD3 antibody having two identical HC1 and two identical LC1 and a monospecific bivalent PSMA antibody having two identical HC2 and two identical LC2 in a mixture of about 1:1 molar ratio; introducing a reducing agent into the mixture; incubating the mixture about ninety minutes to about six hours; removing the reducing agent; and purifying the bispecific CD3×PSMA antibody that comprises the HC1, the LC1, the HC2 and the LC2.

Further described are methods of treating a cancer in a subject, comprising administering a therapeutically effective amount of the isolated antibodies described to the subject in need thereof for a time sufficient to treat the cancer.

The disclosure also provides kits comprising the antibodies described herein. The kits can further comprise reagents for detecting the antibodies and instructions of use.

BRIEF DESCRIPTIONS OF THE DRAWINGS

The summary, as well as the following detailed description, is further understood when read in conjunction with the appended drawings. For the purpose of illustrating the disclosed antibodies and methods, there are shown in the drawings exemplary embodiments of the antibodies and methods; however, antibodies and methods are not limited to the specific embodiments disclosed. In the drawings:

FIGS. 1A and 1B show anti-CD3 antibodies produced in OmniRat. VH (FIG. 1A) and VL (FIG. 1B) sequences of active anti-CD3 mAbs produced in OmniRat were aligned with human germline sequences from IMGT. CDR regions are underlined. Sequence divergence is shown in bold. FIG. 1A discloses SEQ ID NOS 651, 651, 653, 656, 655, 20, 654 and 717 and FIG. 1B discloses SEQ ID NOS 658, 688, 660, 659, 659, 659, 659 and 718, all respectively, in order of appearance.

Figure 9:
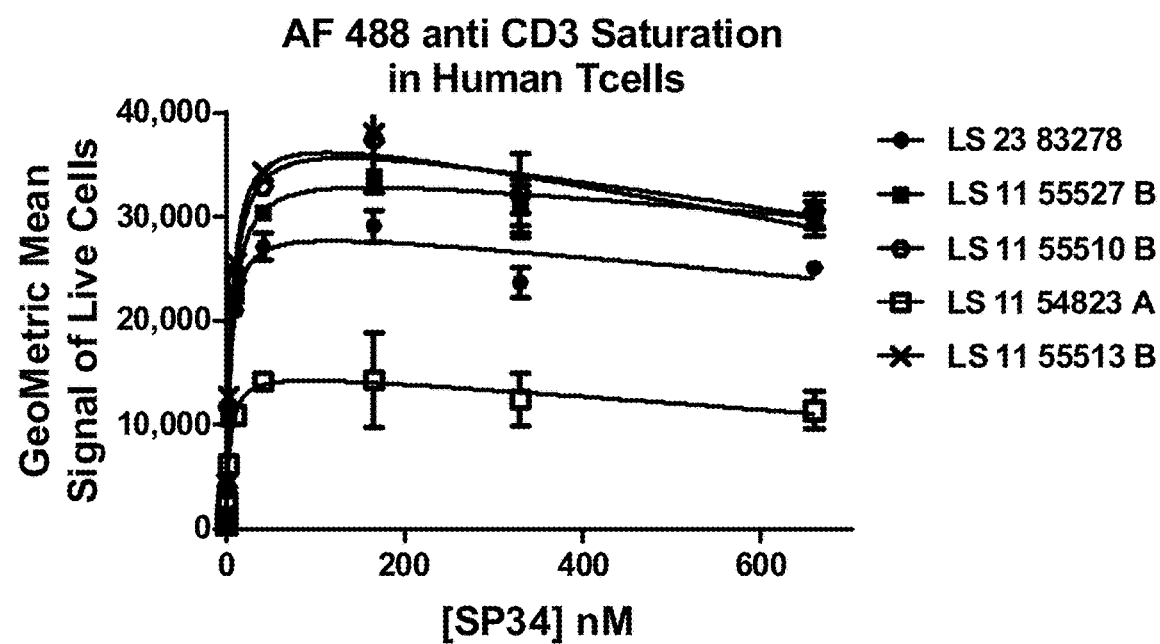

FIG. 9 shows AlexaFluor™ (AF) 488 CD3 Saturation in Human T Cells by FACS analysis. Acquired mean fluorescence intensity values were plotted as a function of the antibody molecule concentration. Kd values were derived for each donor, and the mean value obtained. The Saturation Binding Constant (KdT) for human T-Cells was derived to be 5.6±1.0 nM (n=4) and was used herein to determine Kd binding affinities. One human donor was excluded as it failed the viability criteria of being at least 60% during analysis. "LS" identifiers in figure legend refer to individual human T cell donors.

Figure 10:
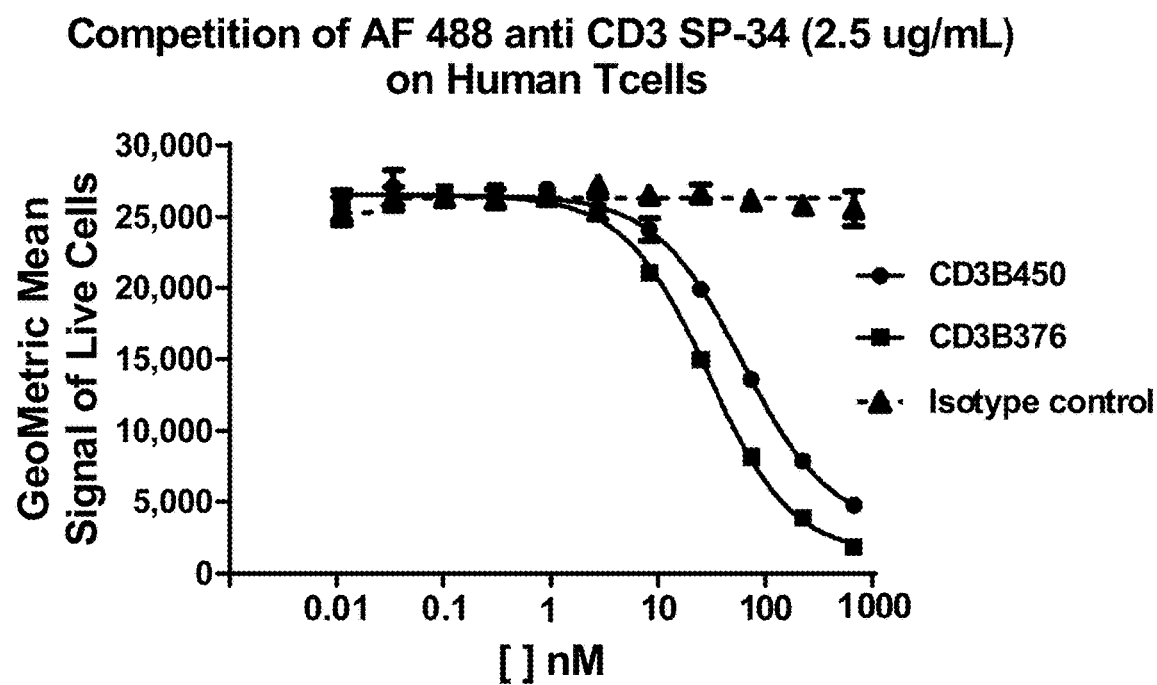

FIG. 10 shows inhibition curves for the bivalent anti CD3 antibodies, CD3B376 and CD3B450, for competing for binding against the AlexaFluor488 SP-34 anti CD3 antibody. IC50 values were derived to be 29 and 60 nM respectively.

Figure 11:
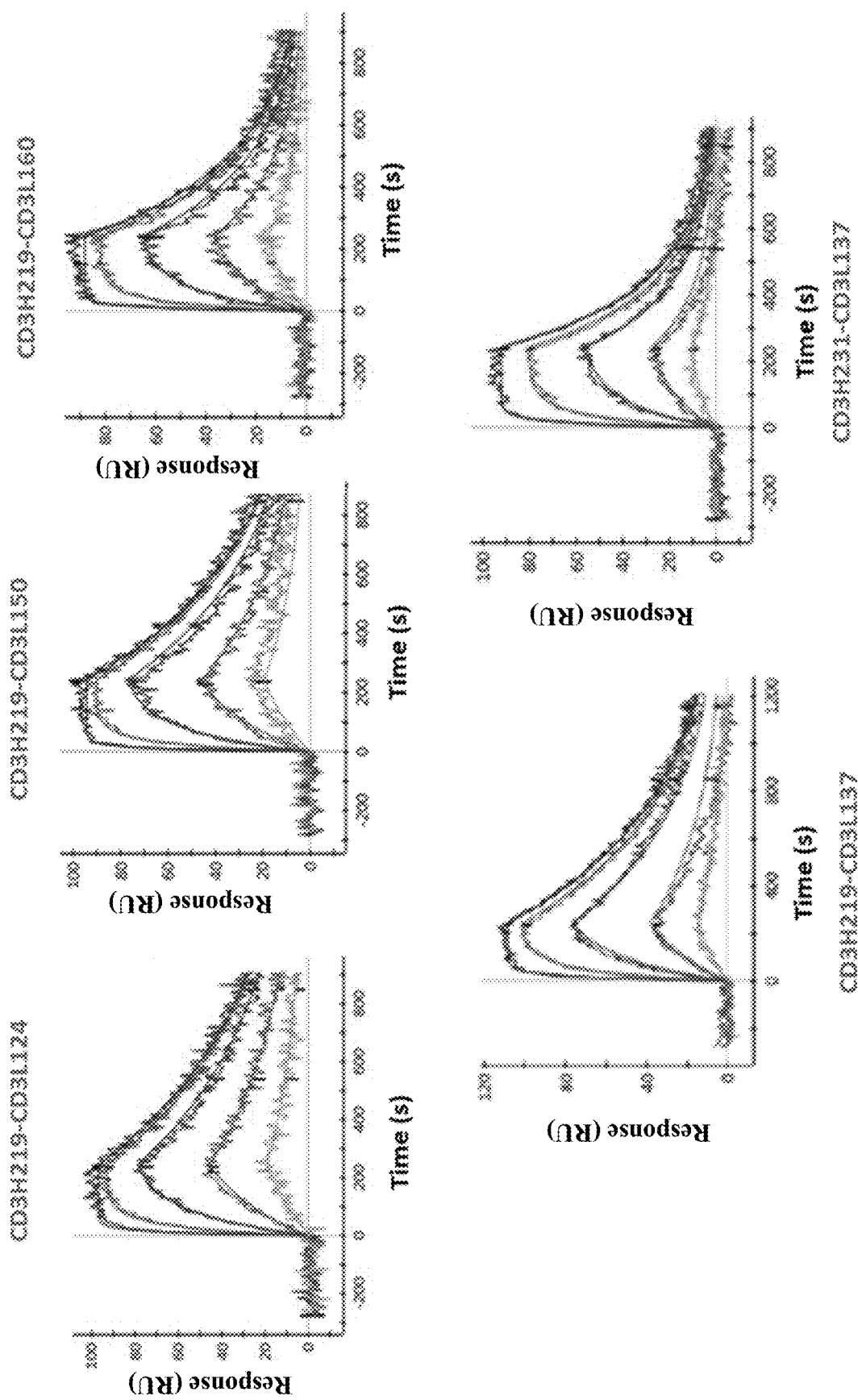

FIG. 11 shows sensorgrams of BLW-2E6 variants binding to hCD3ε(1-27)-Tn25.

Figure 12A:
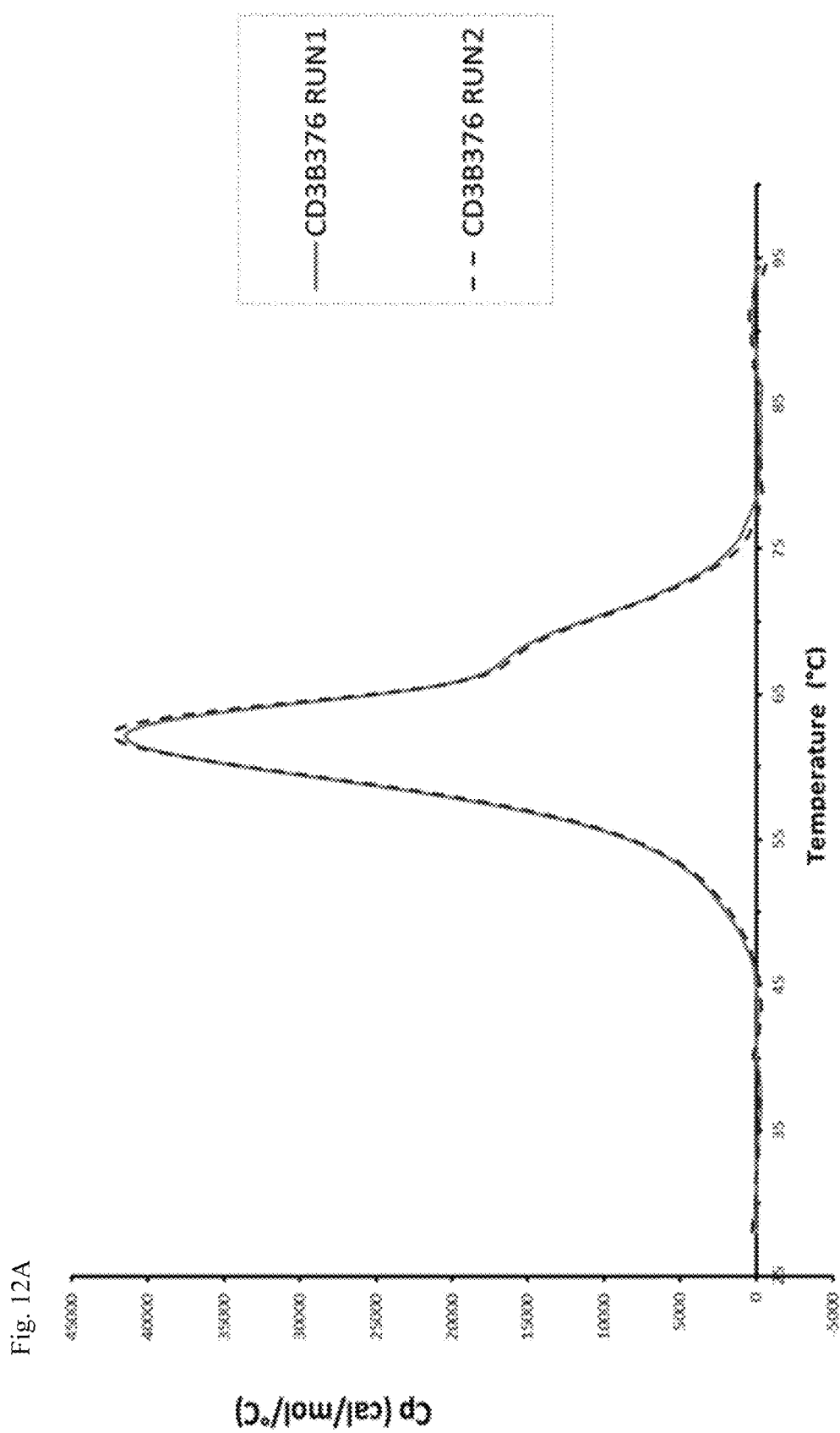
Figure 12B:
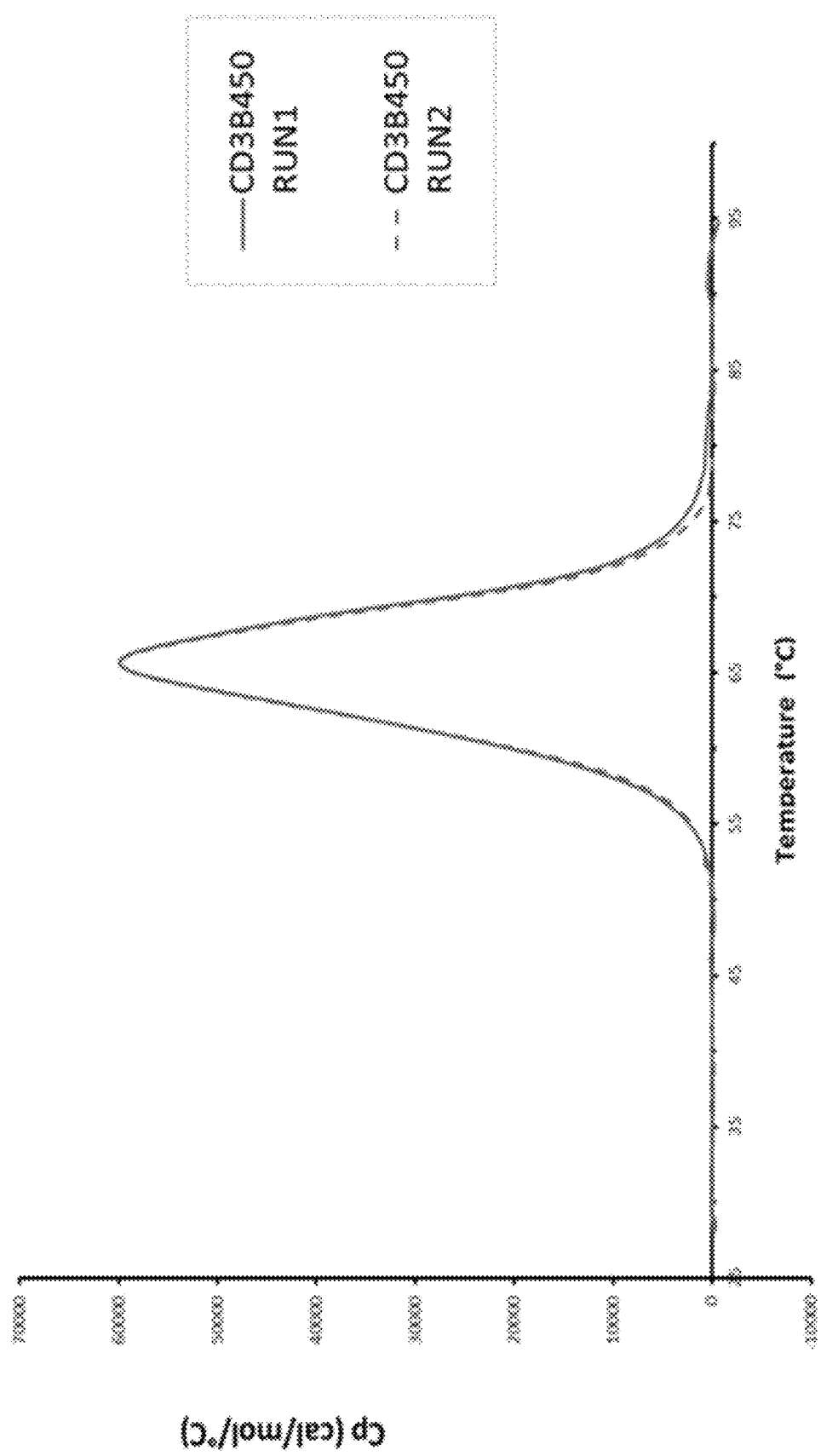
Figure 12C:
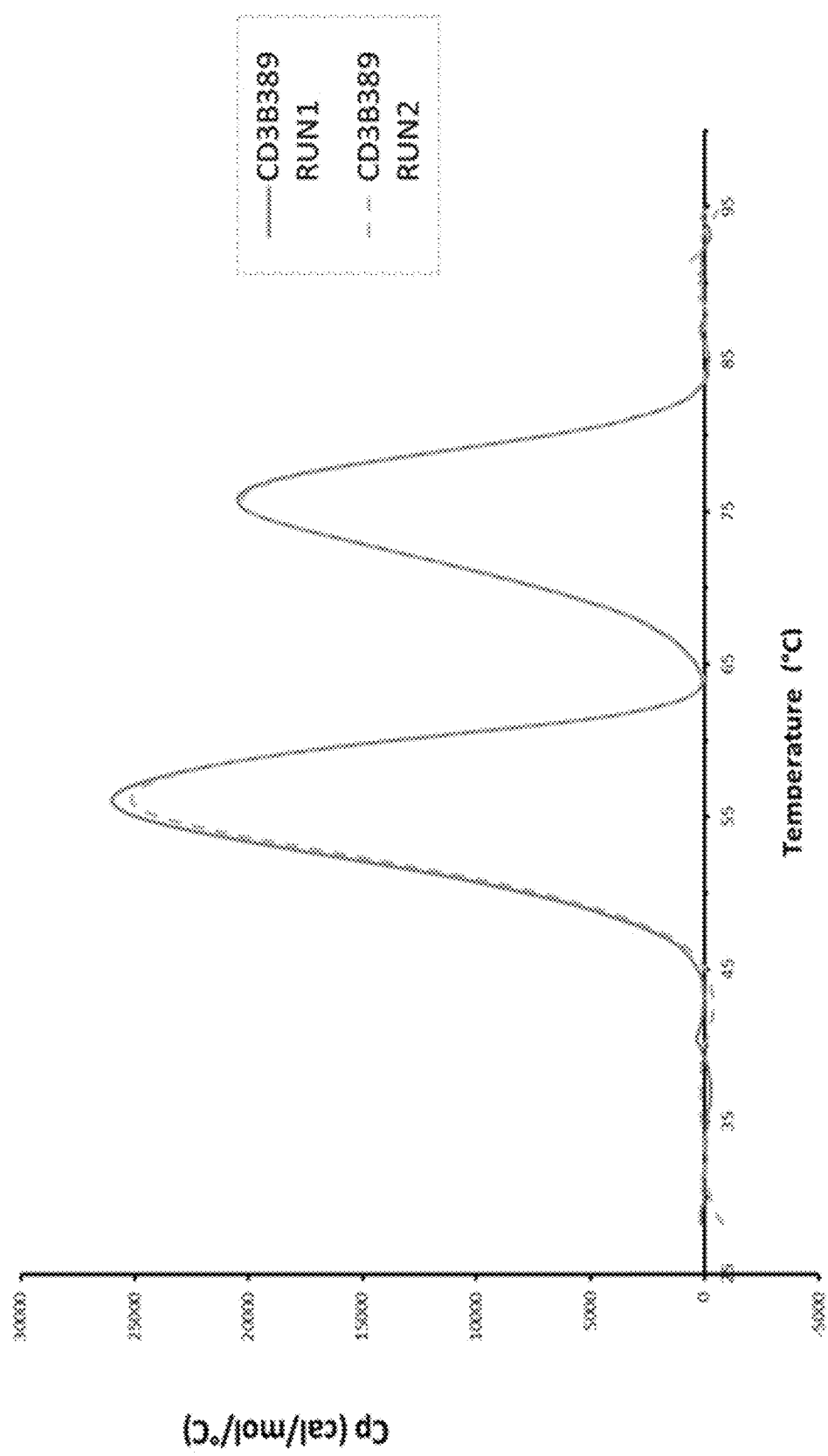
Figure 12D:
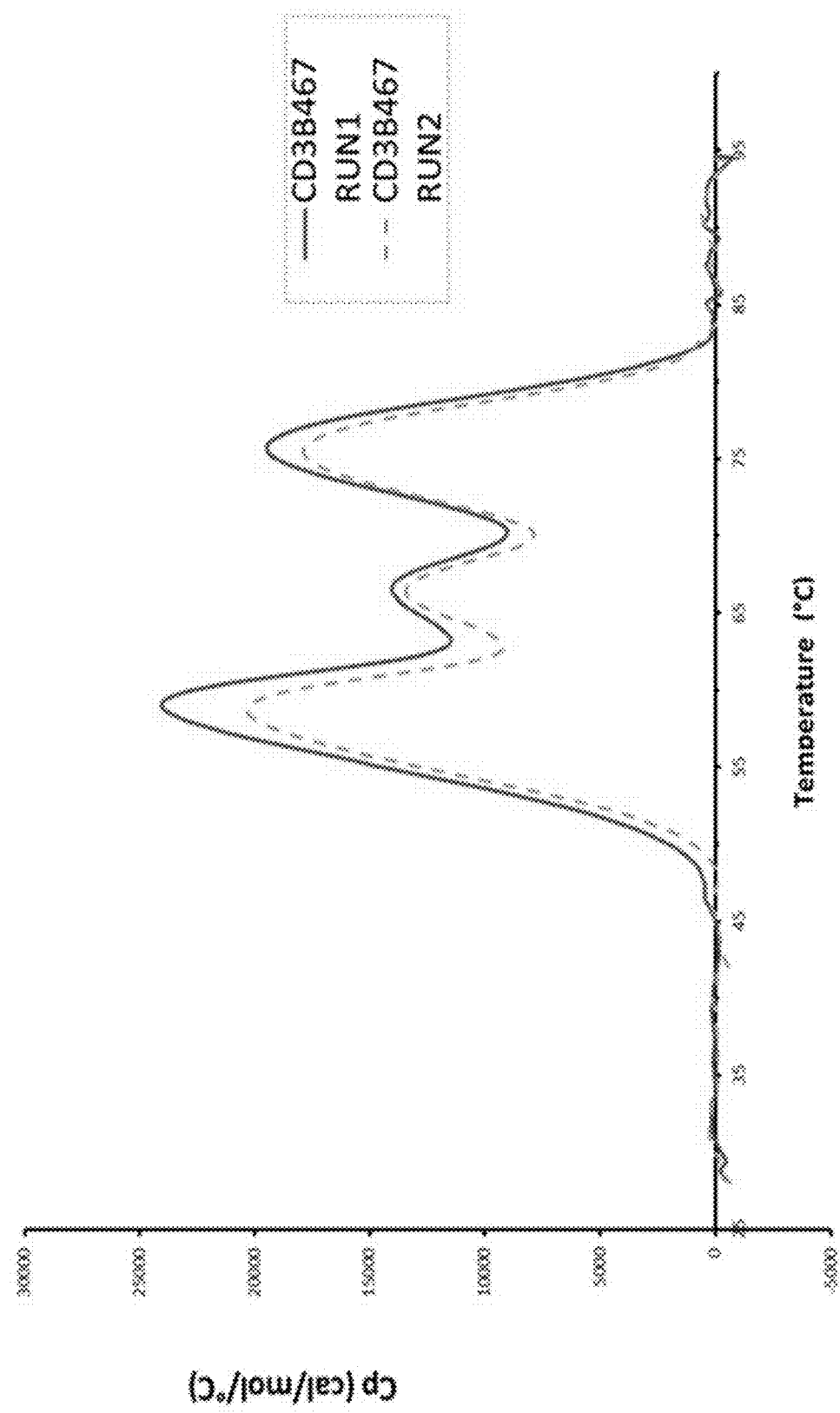
Figure 12E:
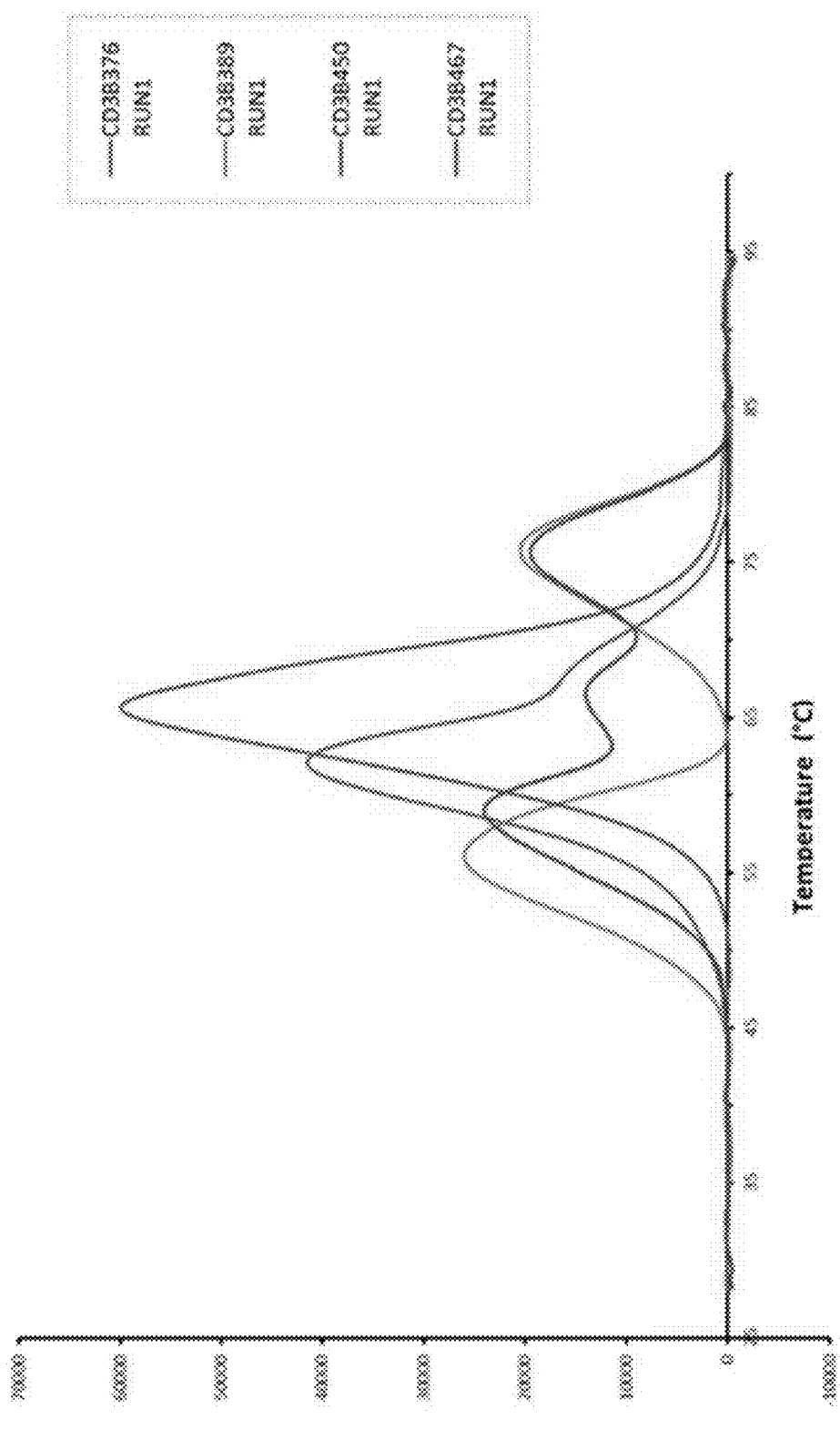

FIGS. 12A-12E shows thermal stability of anti-CD3 antibodies CD3B376 (FIG. 12A), CD3B450 (FIG. 12B), CD3B389 (FIG. 12C), CD3B467 by DSC (FIG. 12D), and overlay of the thermograms for all the candidates (FIG. 12E).

Figure 13A:
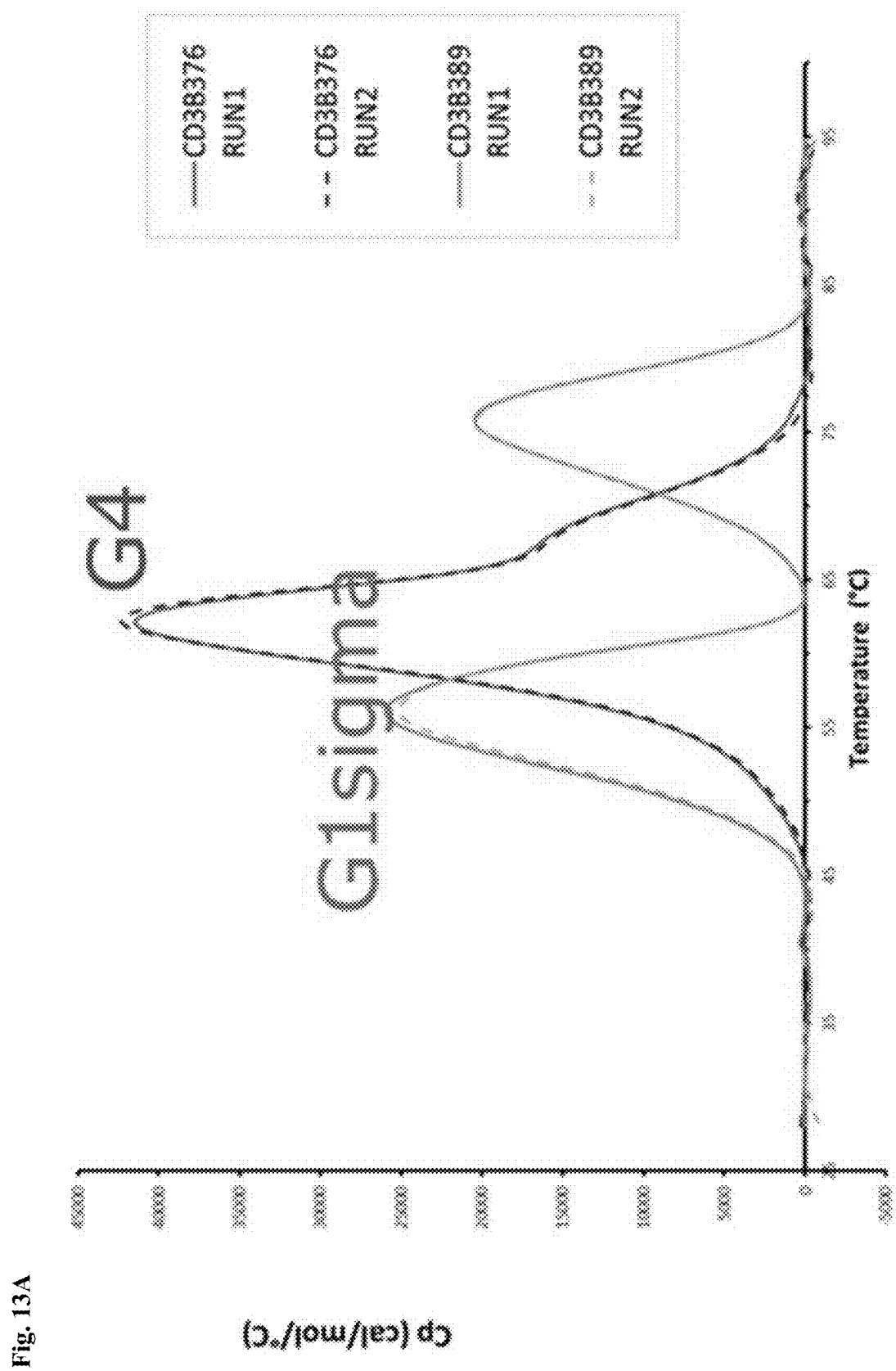
Figure 13B:
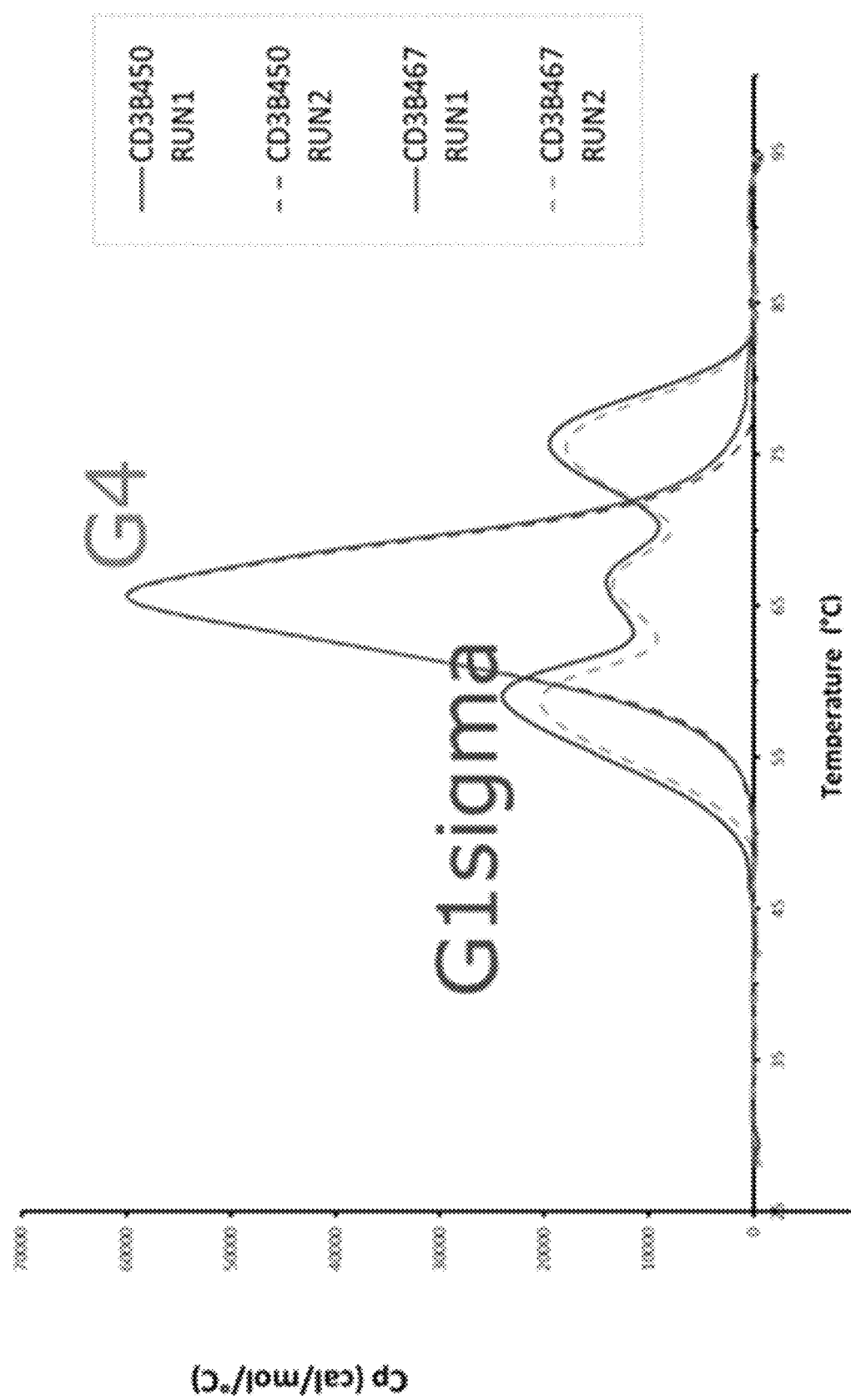

FIGS. 13A-13B show comparisons of the thermal stability of anti-CD3 antibodies overlay of thermograms for CD3B376 and CD3B389 (FIG. 13A); overlay of thermograms for CD3B450 and CD3B467 (FIG. 13B).

Figure 14:
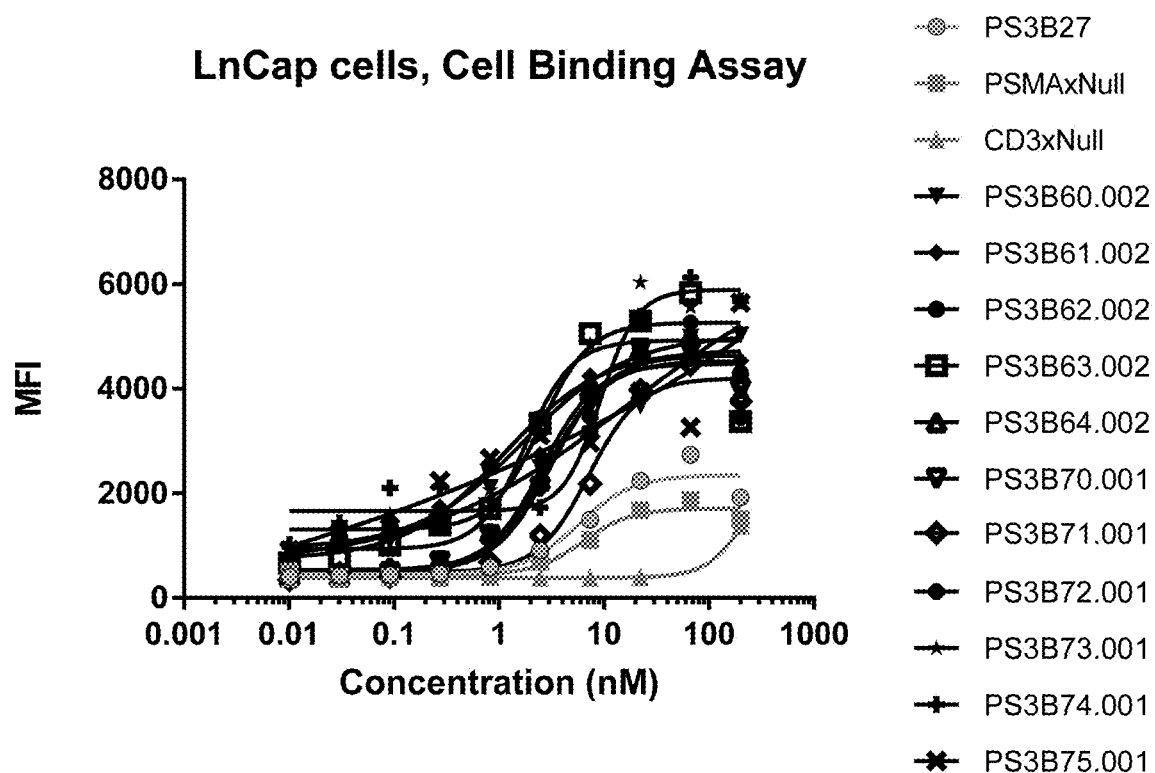

FIG. 14 shows LNCAP cell binding of a subset of affinity-matured PSMA×CD3 bispecific antibodies.

Figure 15:
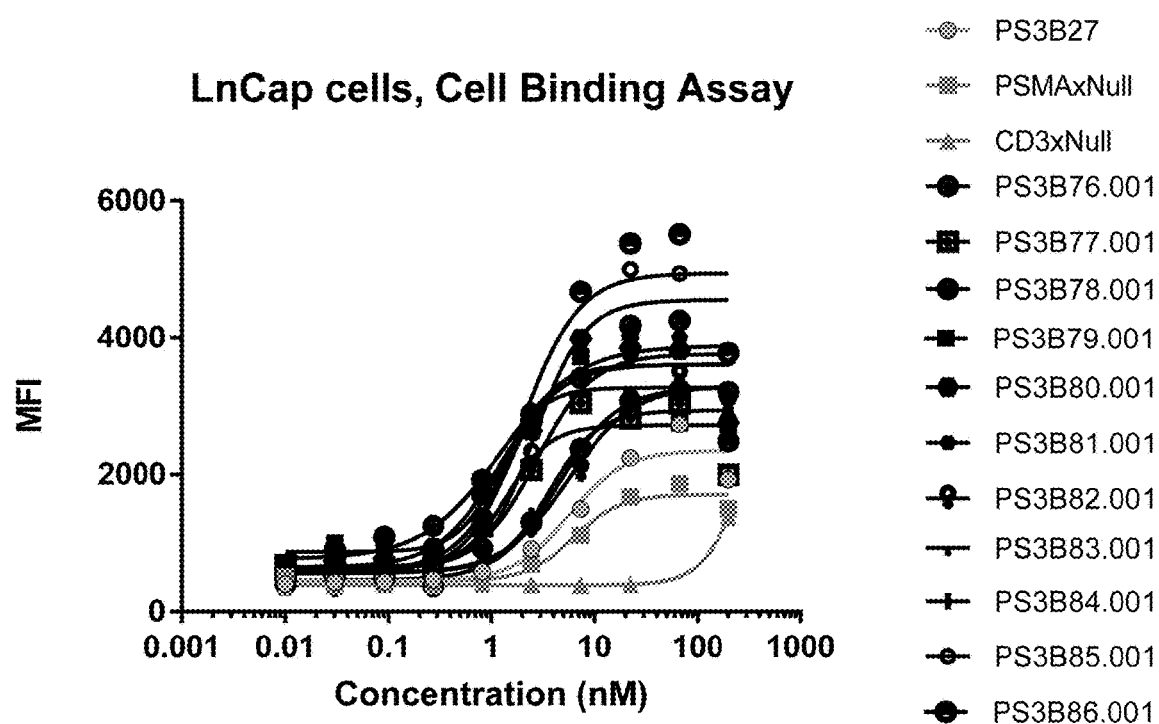

FIG. 15 shows LNCAP cell binding of a subset of affinity-matured PSMA×CD3 bispecific antibodies.

Figure 16:
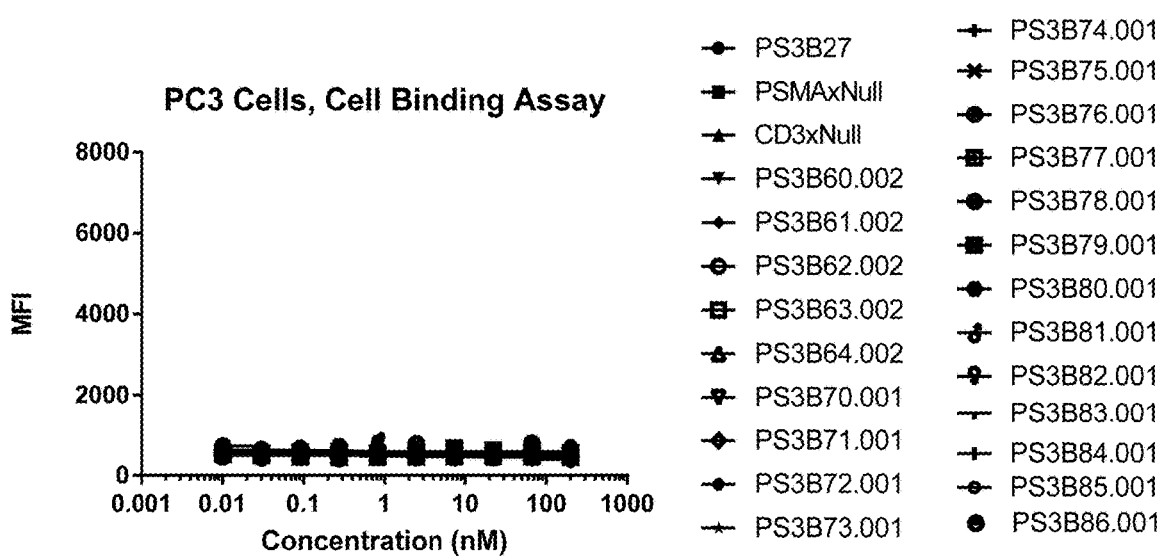

FIG. 16 shows PSMA-negative PC3 cell binding results of affinity-matured PSMA×CD3 bispecific antibodies.

Figure 17:
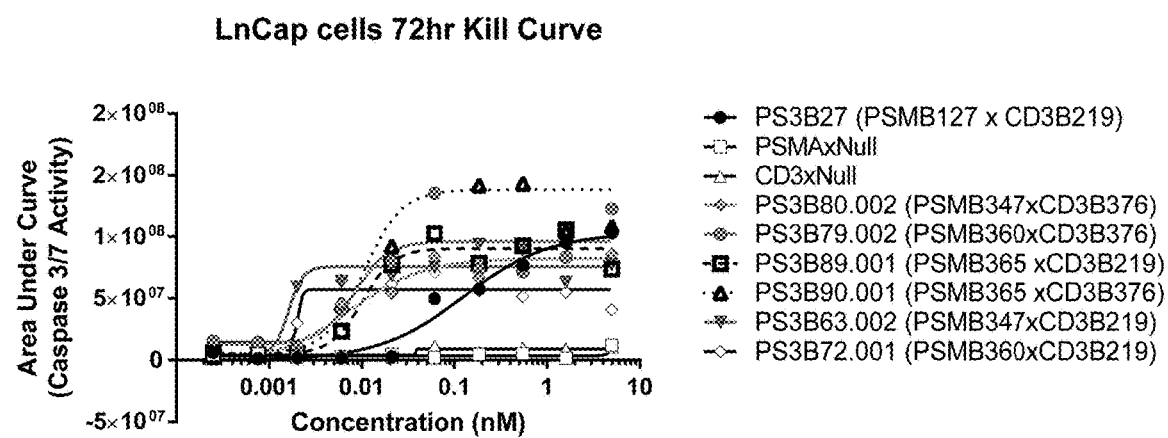

FIG. 17 shows results of PSMA×CD3 Affinity Matured Bispecific Abs in a Functional Cell Killing Assay.

Figure 18:
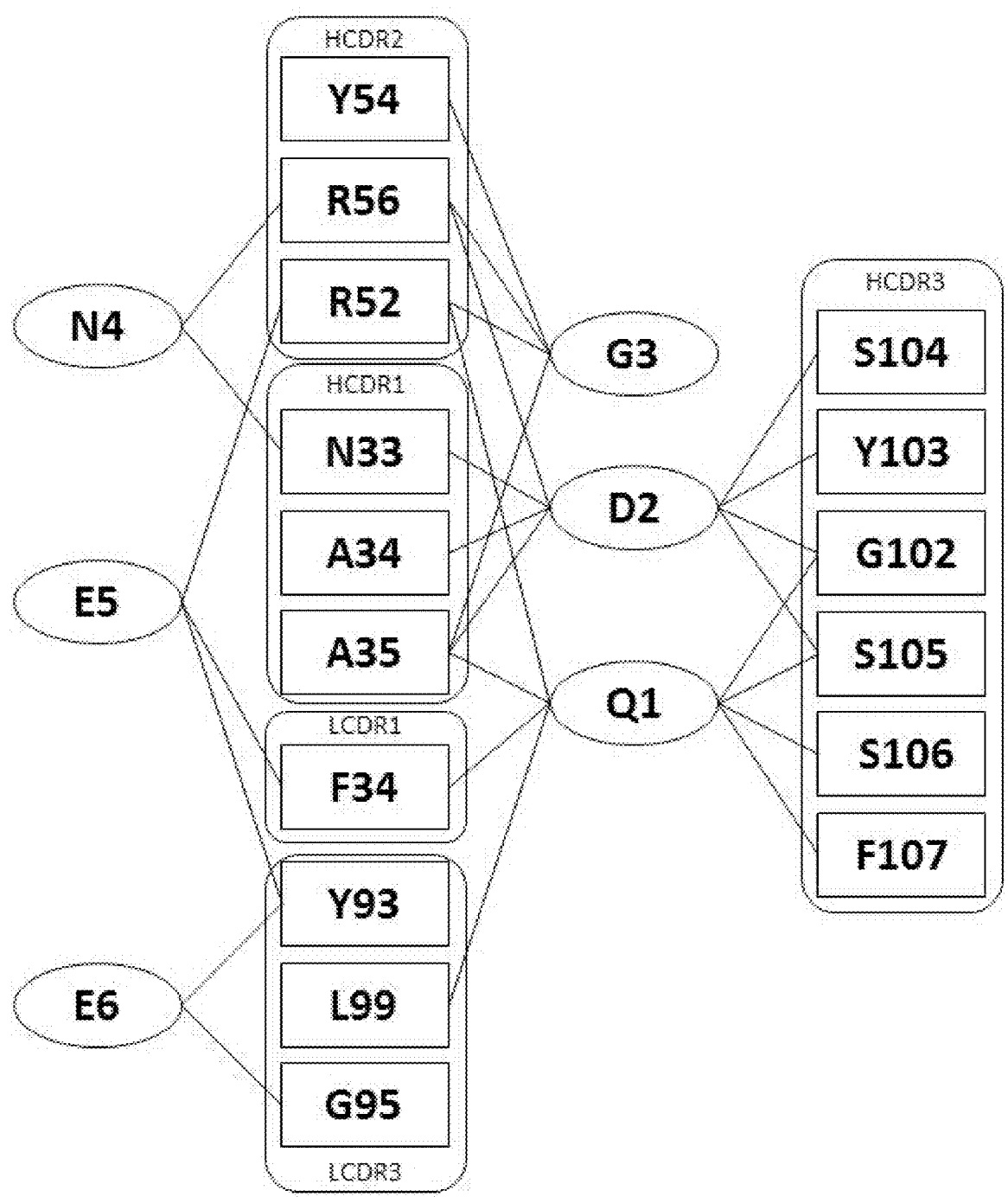

FIG. 18 shows antibody-antigen interactions in the CD3B334:CD3 complex. CD3 residues are in ellipses, CD3B334 residues are in boxes.

Figure 19:
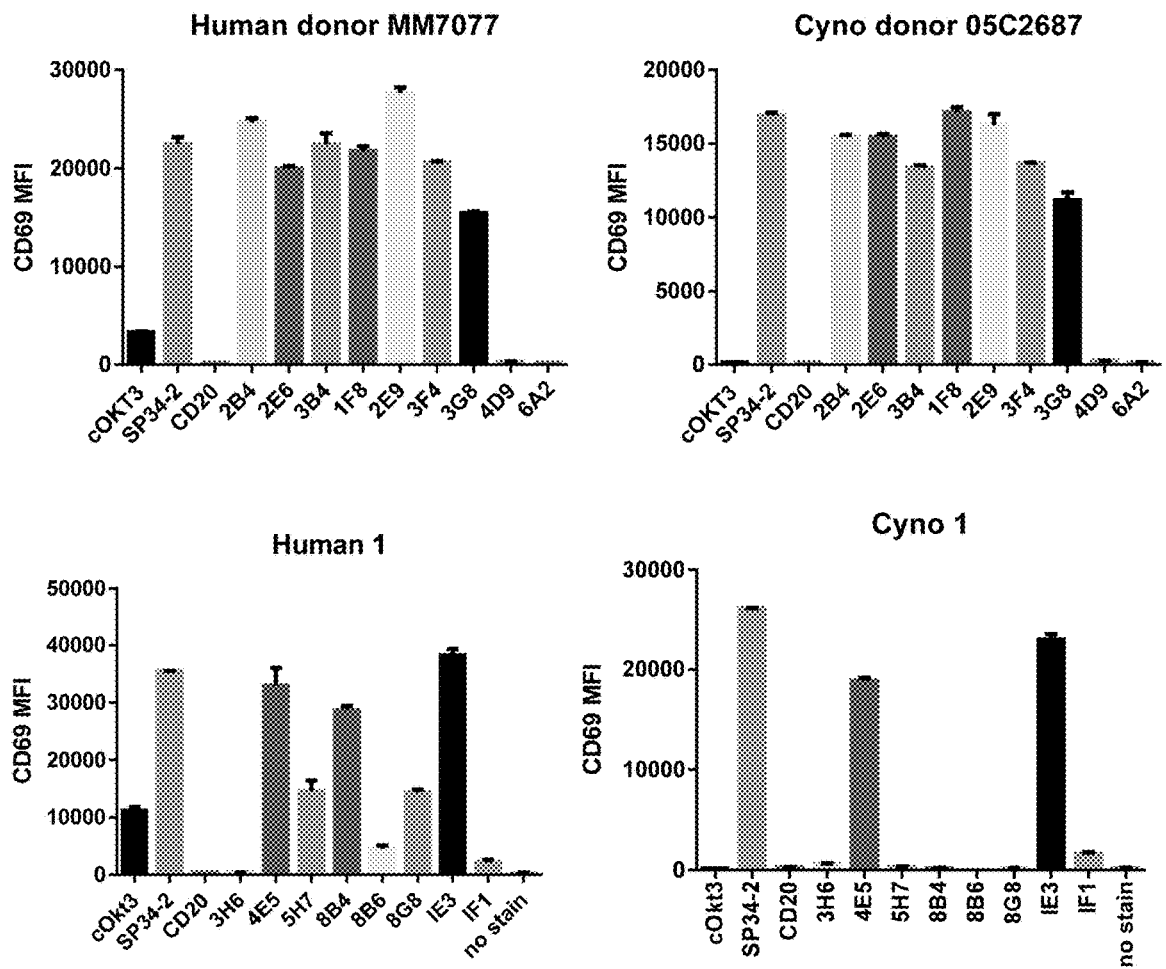

FIG. 19 shows a primary human and cynomolgus monkey T cell based assay used to determine the capacity of the hybridoma hits to activate T cells as measured by CD69 activation.

Figure 20:
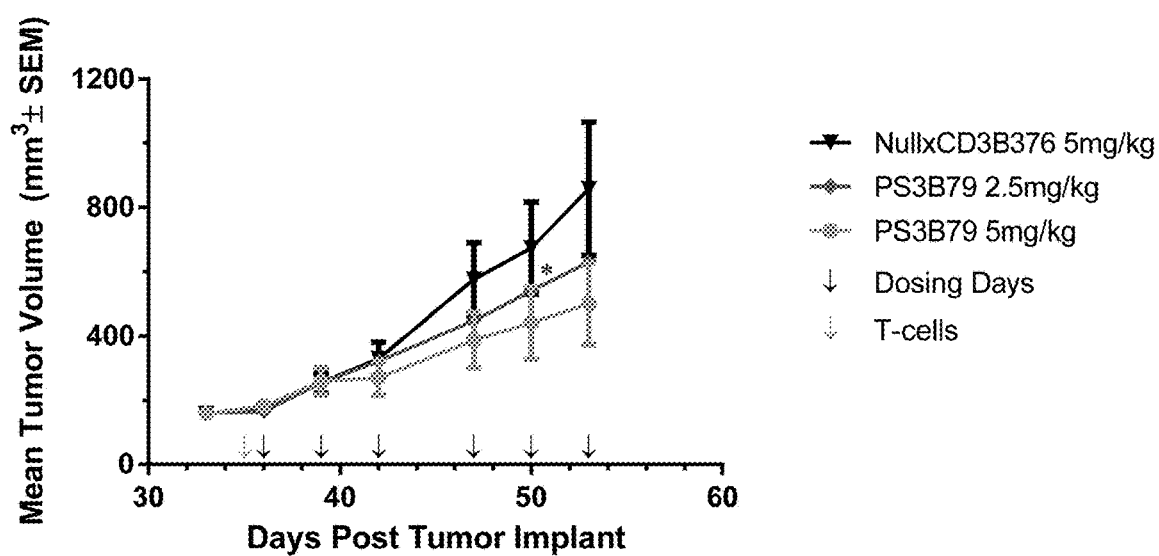

FIG. 20 shows anti-tumor efficacy of PS3B79 in LnCAP AR.TB human prostate xenografts in T cell humanized NSG mice. Subcutaneous LnCAP AR.TB tumors were measured twice weekly and the results presented as the mean tumor volume, expressed in mm$^3$±SEM (*, p<0.0001).

Figure 21:
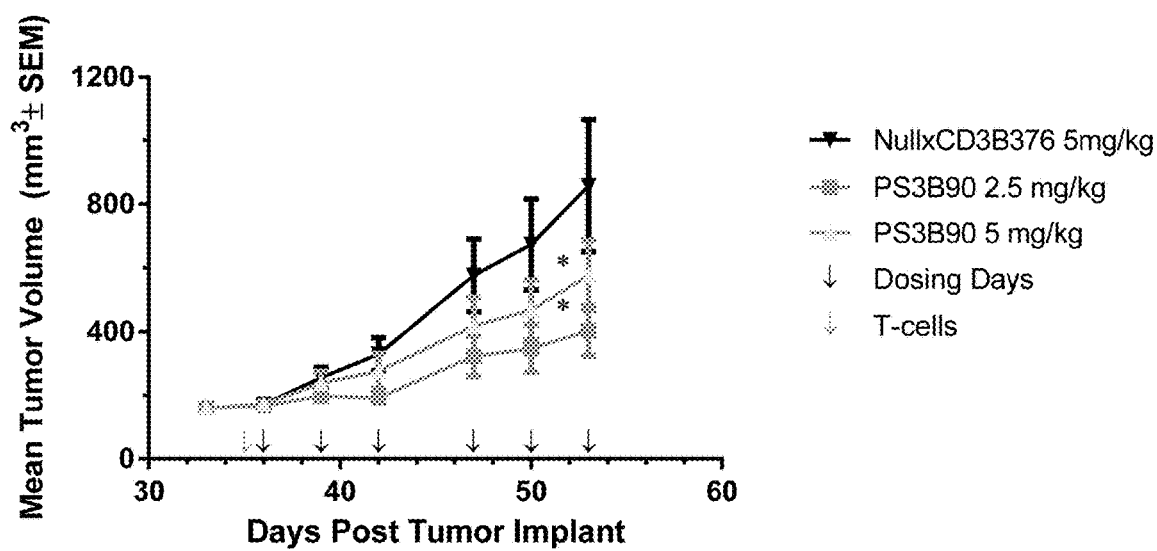

FIG. 21 shows anti-tumor efficacy of PS3B90 in LnCAP AR.TB human prostate xenografts in T cell humanized NSG mice. Subcutaneous LnCAP AR.TB tumors were measured twice weekly and the results presented as the mean tumor volume, expressed in mm$^3$±SEM (*, p<0.001).

Figure 22A:
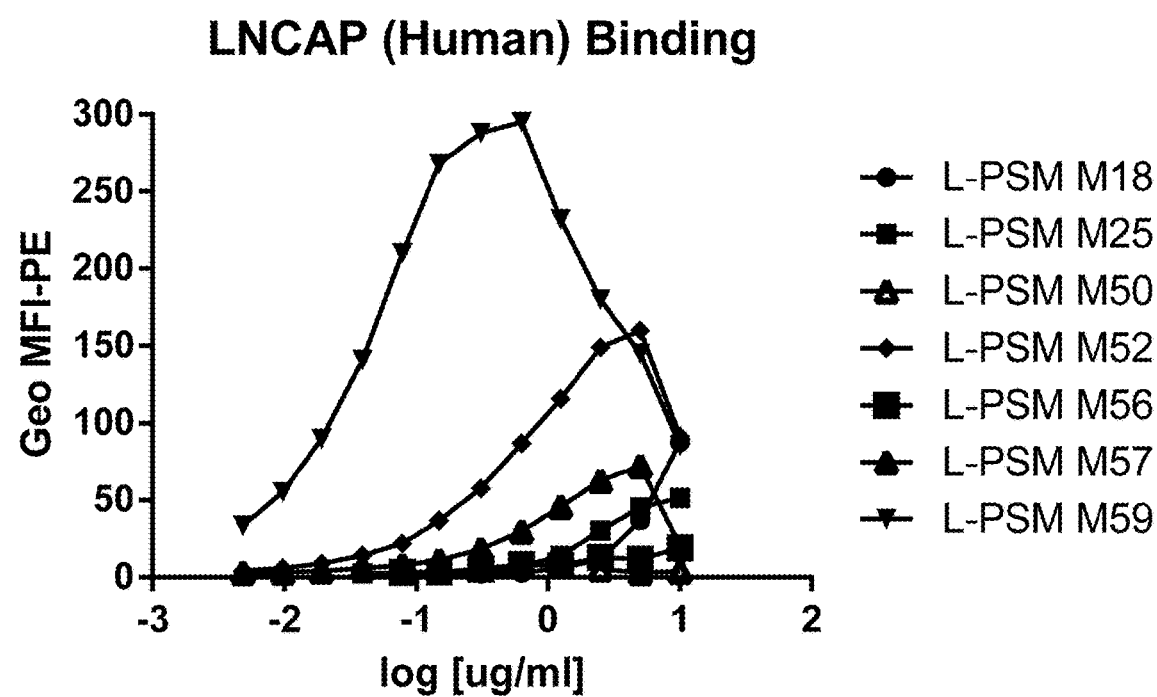
Figure 22B:
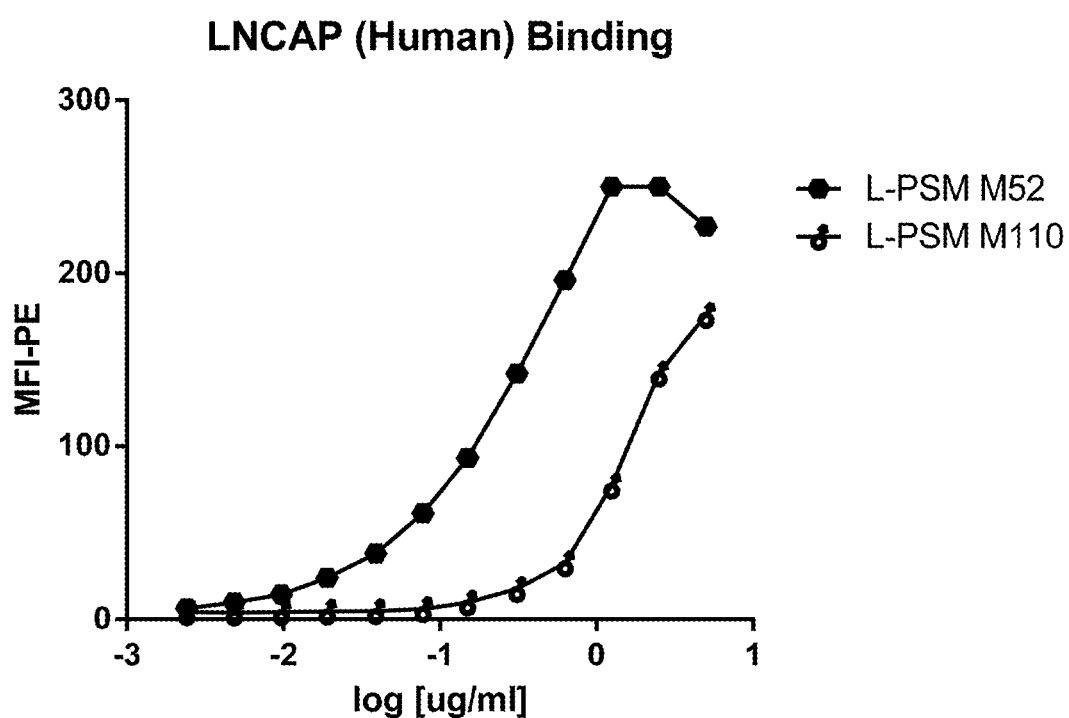
Figure 22C:
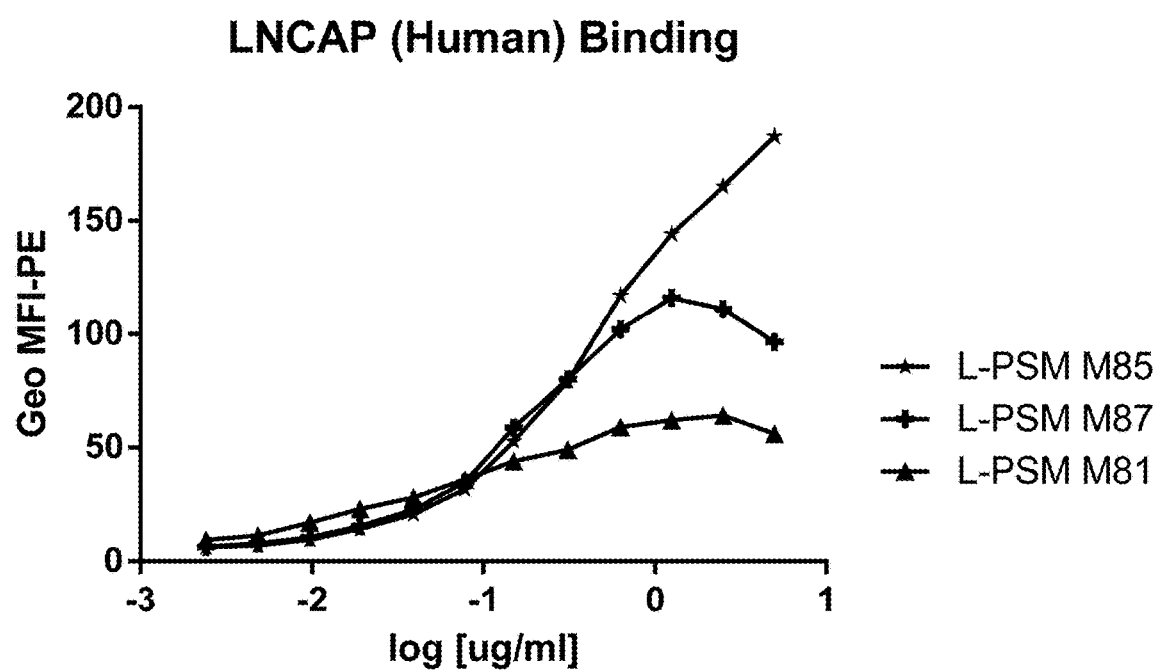
Figure 22D:
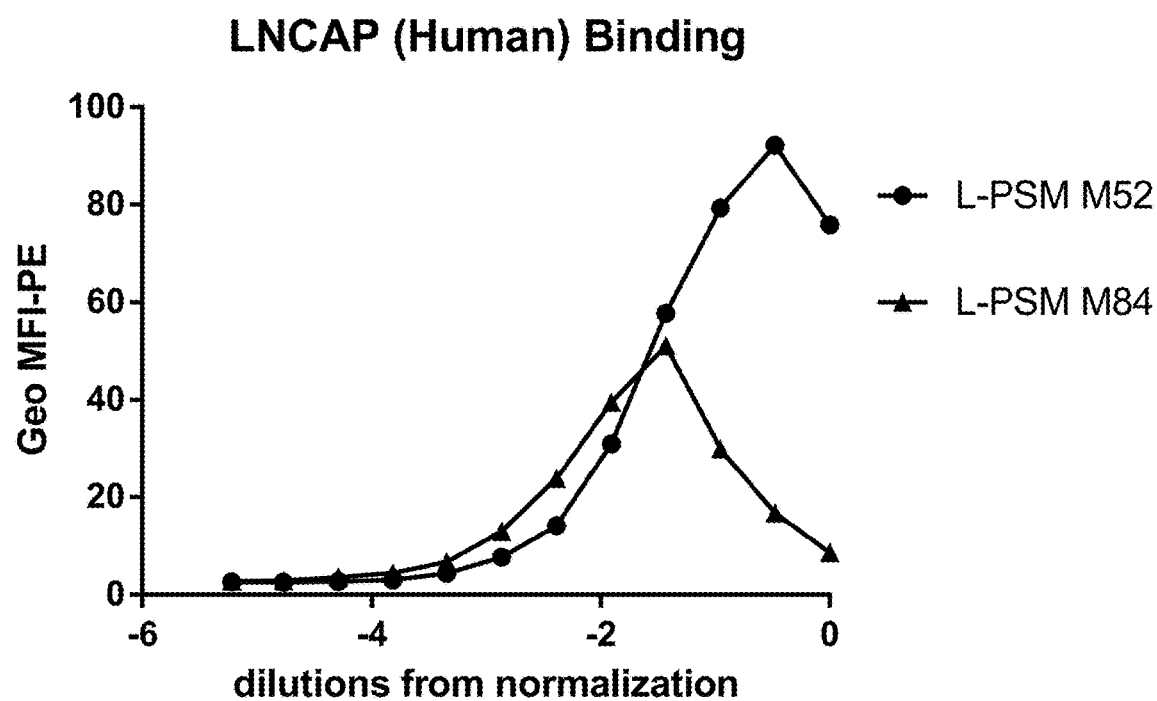

FIGS. 22A-22D show titration curves for Anti-PSMA phage panning hits binding to human LNCaP cells. FIG. 22A shows titration curves for hits G9-PSM M18, M25, M50, M52, M56, M57, and M59; FIG. 22B shows M52 and M110; FIG. 22C shows M85, M87, and M81; and FIG. 22D shows M52 and M84. In FIG. 22D, Mammalian-expressed supernatants were normalized for Fab expression via octet, and titrated against either human LNCAP, PSMG5 (Cyno-PSMA HEK), or PSMG9 (chimp-PSMA HEK) cells using flowcytometry. Geometric mean fluorescence intensity (GeoMFI) was plotted vs. Fab concertation using GraphPad Prizm.

Figure 23A:
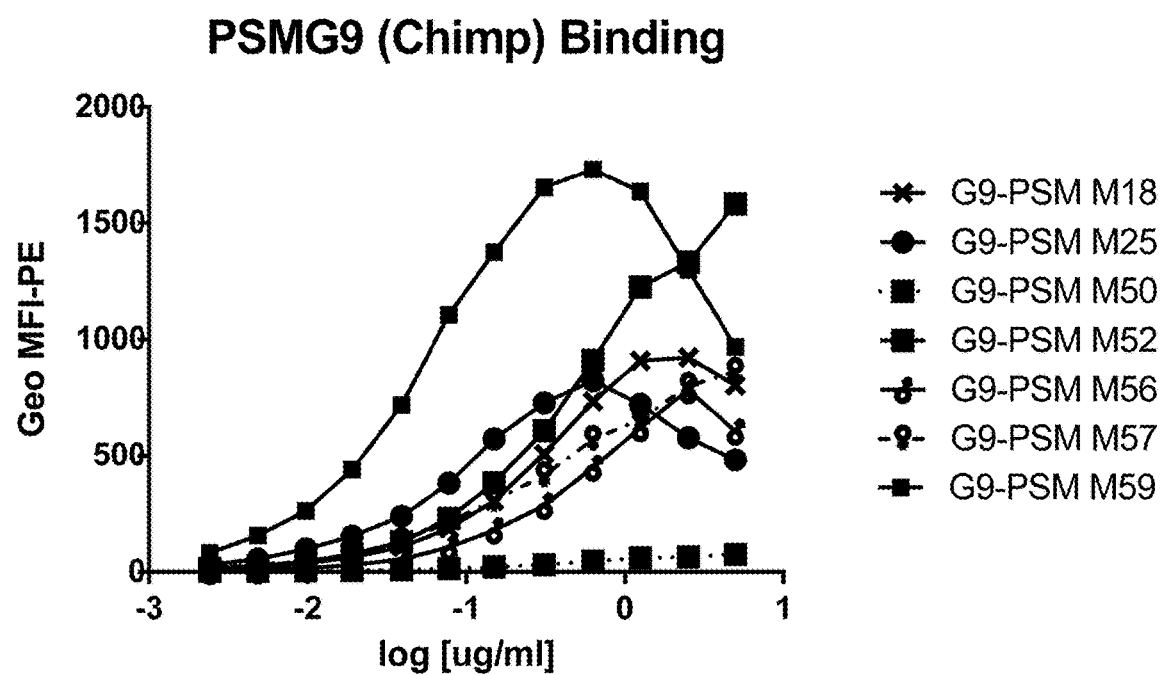
Figure 23B:
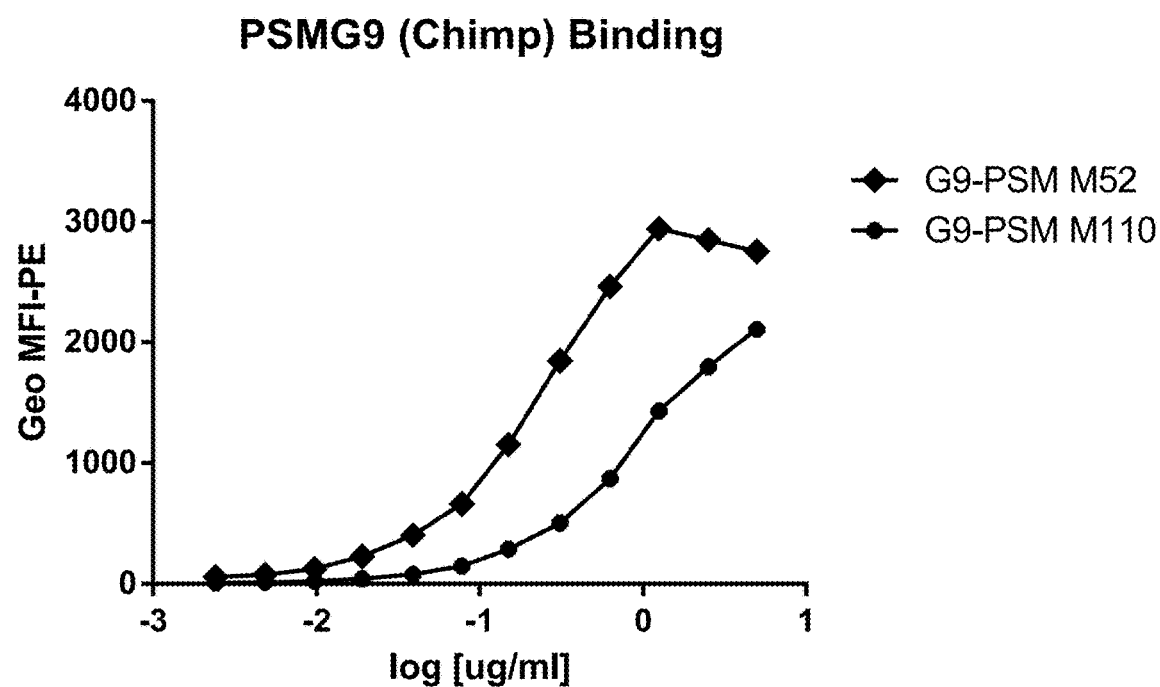
Figure 23C:
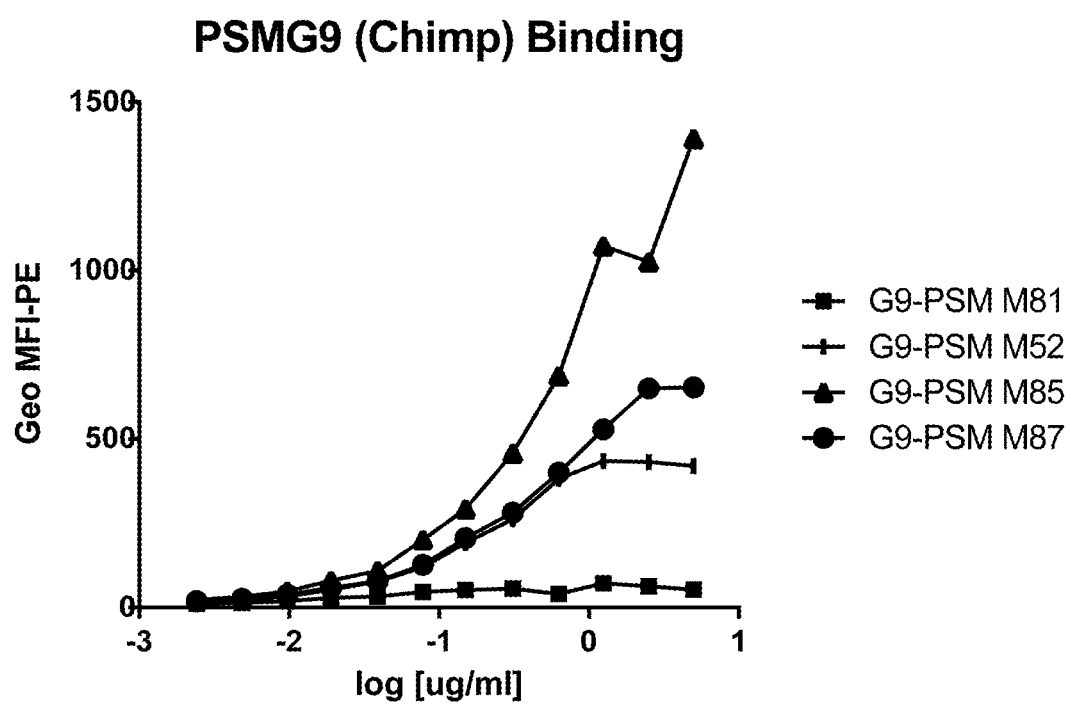
Figure 23D:
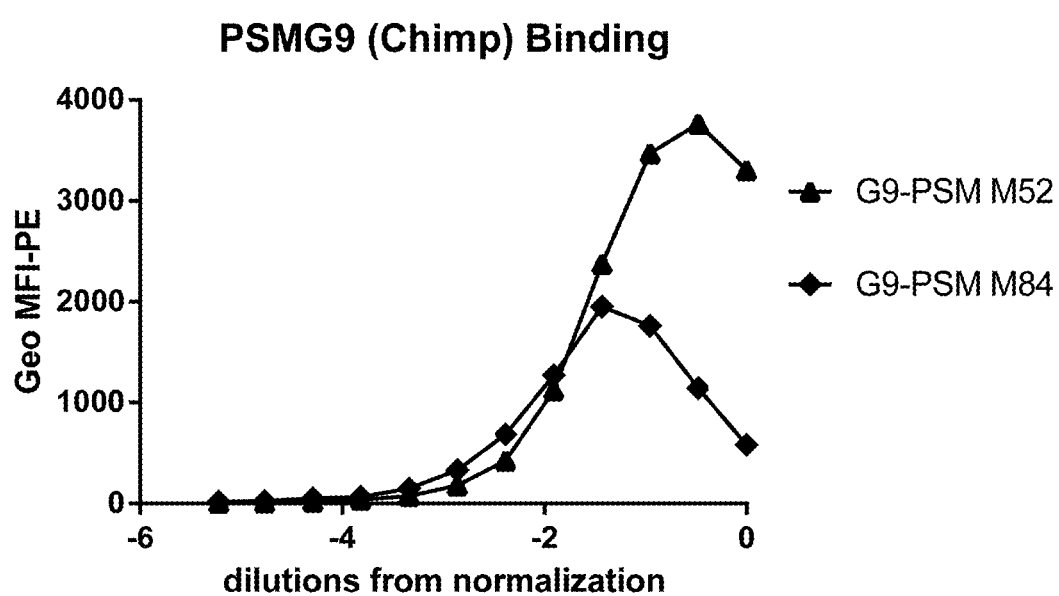

FIGS. 23A-23D show titration curves for Anti-PSMA phage panning hits binding to Chimpanzee-PSMA expressing HEK cells shows. (Mammalian Fab Supernatant Titration Curves for Anti-PSMA Phage Panning Hits vs Chimp-PSMA HEK). FIG. 23A shows titration curves for hits G9-PSM M18, M25, M50, M52, M56, M57, and M59; FIG. 23B shows M52 and M110; FIG. 23C shows M81, M52, M85, and M87; and FIG. 23D shows M52 and M84. In FIG. 23D, Mammalian-expressed supernatants were normalized for Fab expression via octet, and titrated against either human LNCAP, PSMG5 (Cyno-PSMA HEK), or PSMG9 (chimp-PSMA HEK) cells using flowcytometry. Geometric mean fluorescence intensity (GeoMFI) was plotted vs. Fab concertation using GraphPad Prizm.

Figure 24A:
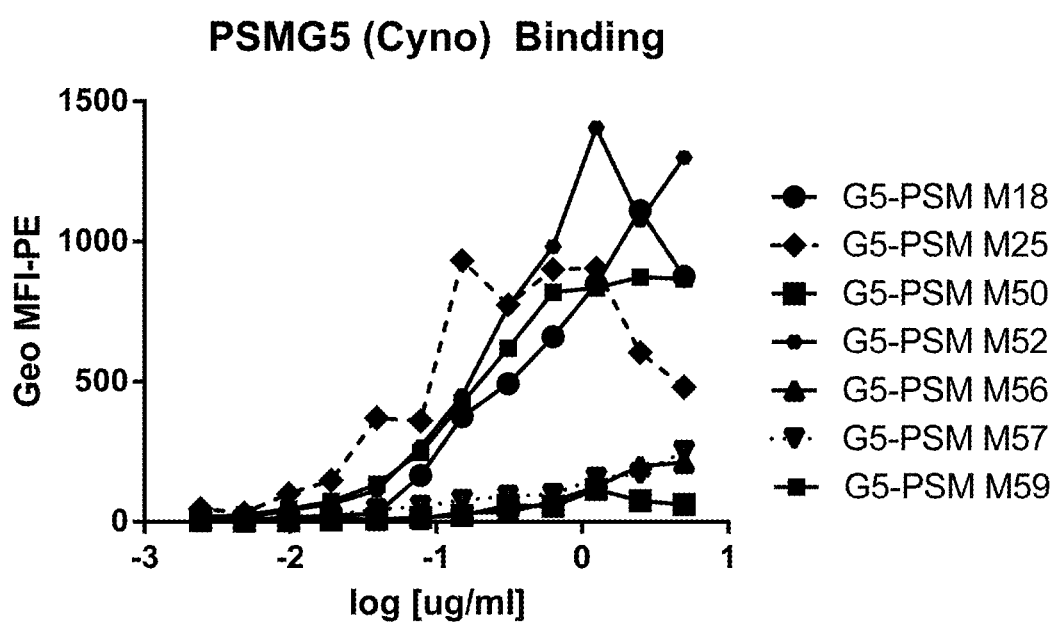
Figure 24B:
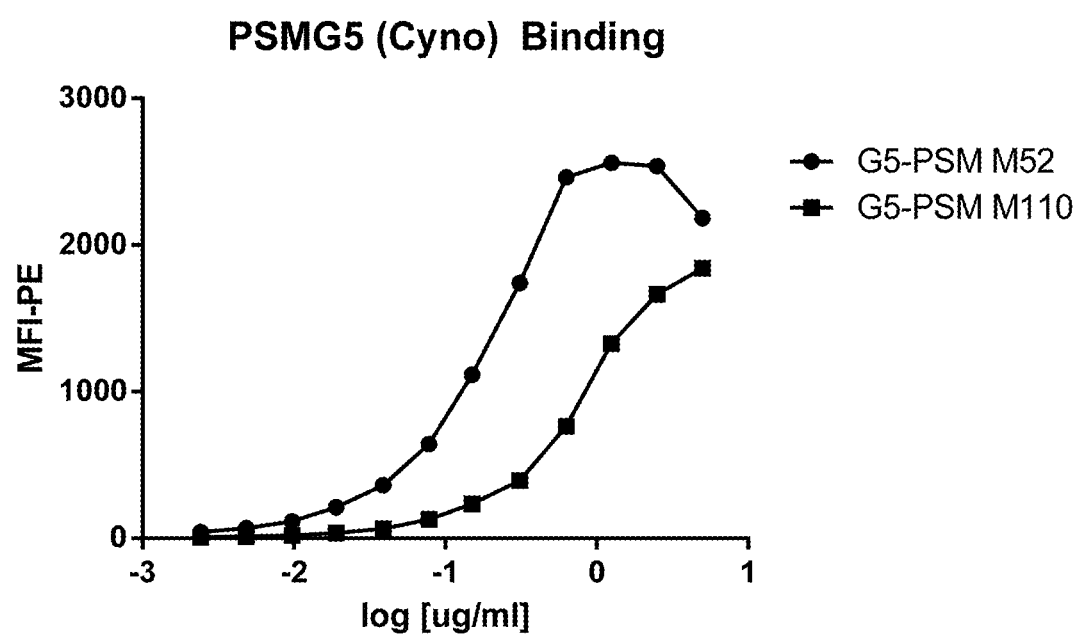
Figure 24C:
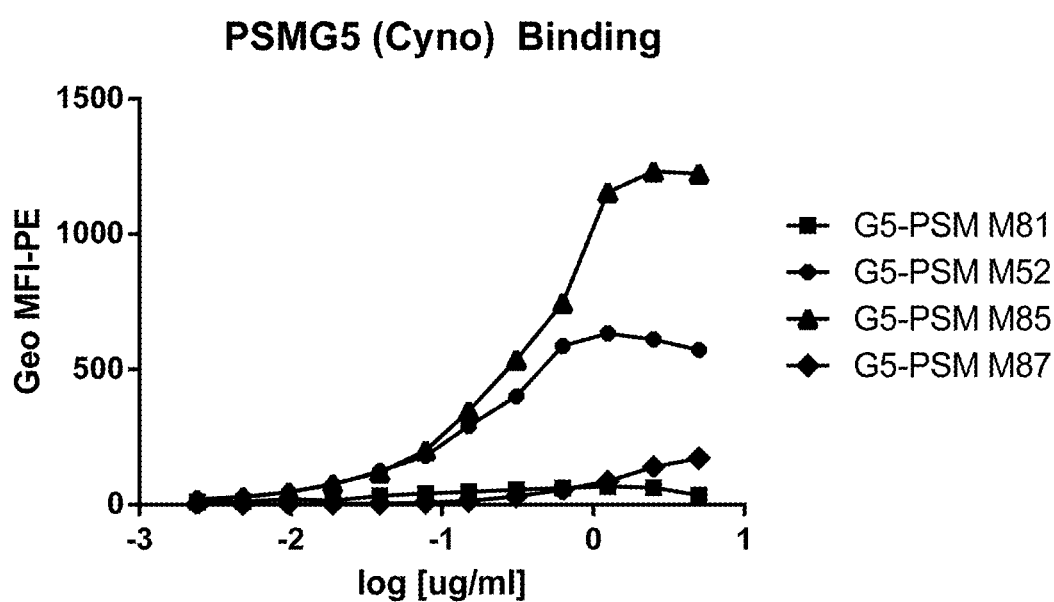
Figure 24D:
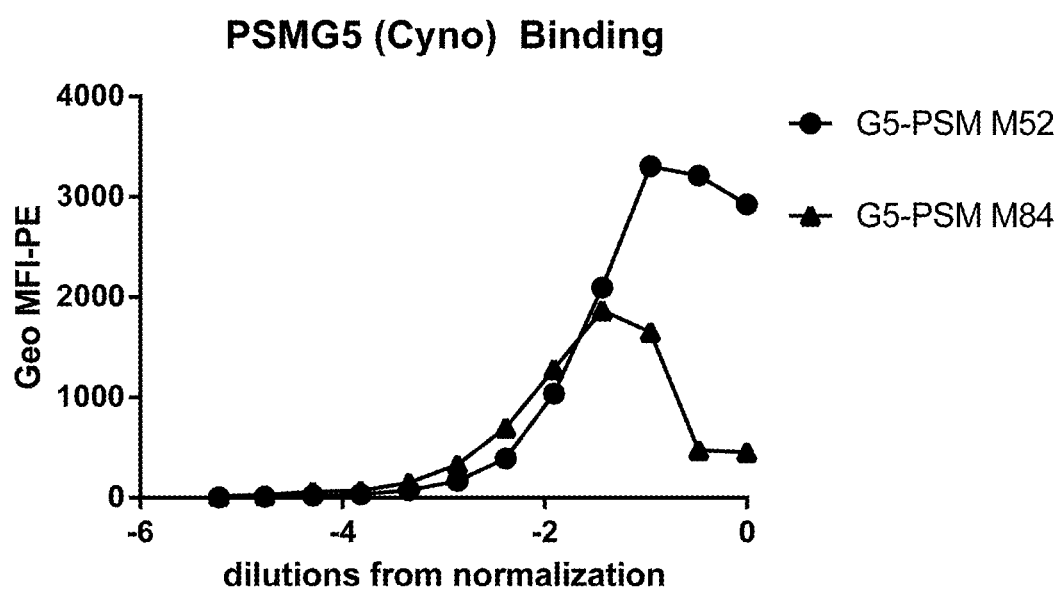

FIGS. 24A-24D show titration curves for Anti-PSMA phage panning hits binding to Cynomolgus monkey PSMA-expressing HEK cells. (Mammalian Fab Supernatant Titration Curves for Anti-PSMA Phage Panning Hits vs Cyno PSMA HEK). FIG. 24A shows titration curves for hits G9-PSM M18, M25, M50, M52, M56, M57, and M59; FIG. 24B shows M52 and M110; FIG. 24C shows M81, M52, M85, and M87; and FIG. 24D shows M52 and M84. In FIG. 24D, Mammalian-expressed supernatants were normalized for Fab expression via octet, and titrated against either human LNCAP, PSMG5 (Cyno-PSMA HEK), or PSMG9 (chimp-PSMA HEK) cells using flow cytometry. Geometric mean fluorescence intensity (GeoMFI) was plotted vs. Fab concertation using GraphPad Prizm.

Figure 25:
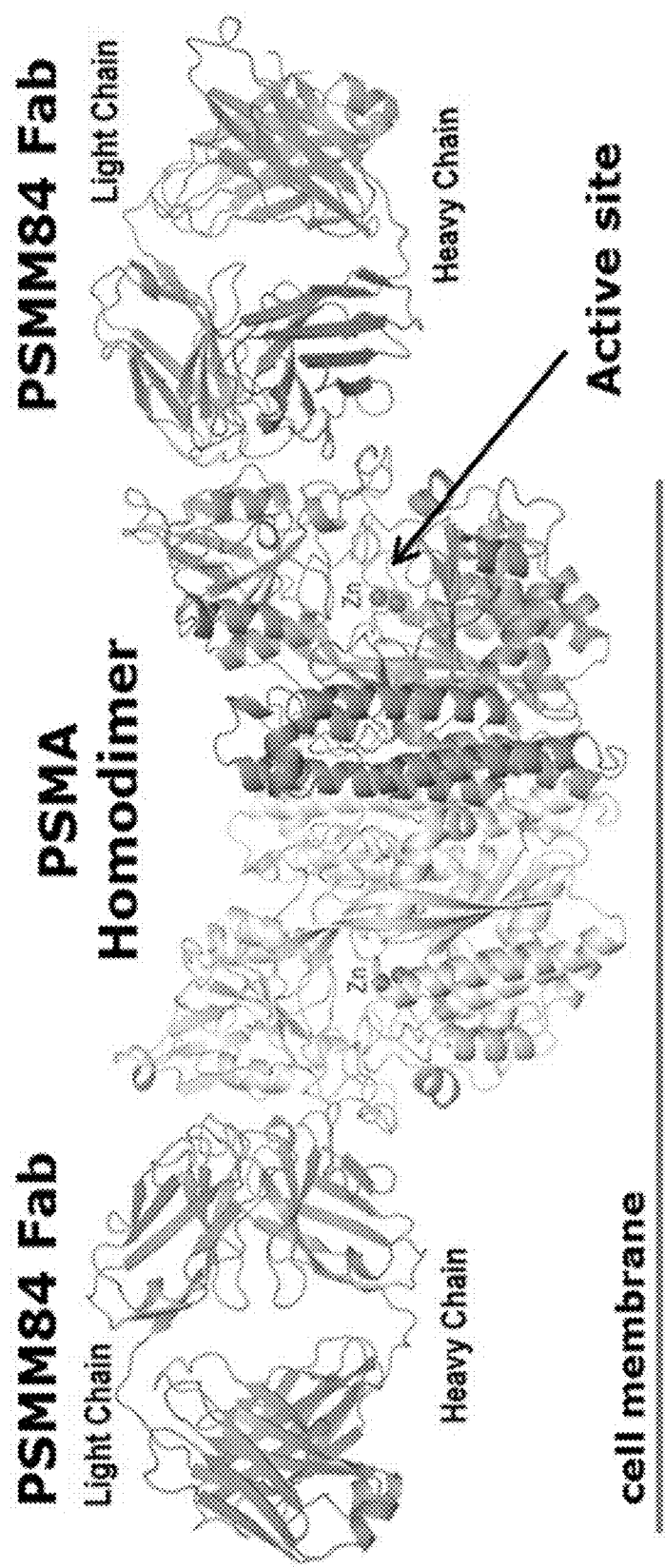

FIG. 25 shows the overall structure of PSMM84 Fab bound to human PSMA ECD homodimer.

Figure 26:
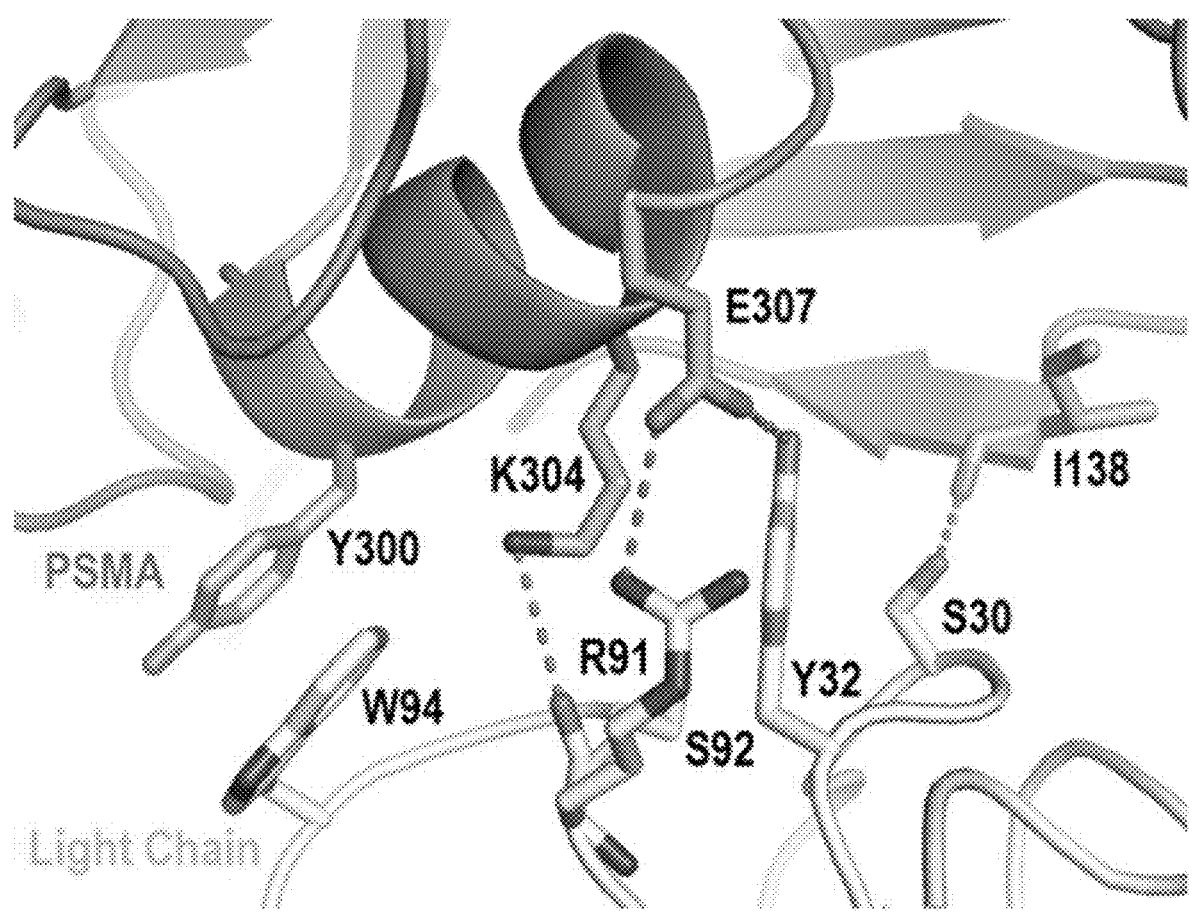

FIG. 26 shows a close view of PSMA main interactions with the PSMB83 Light Chain.

Figure 27:
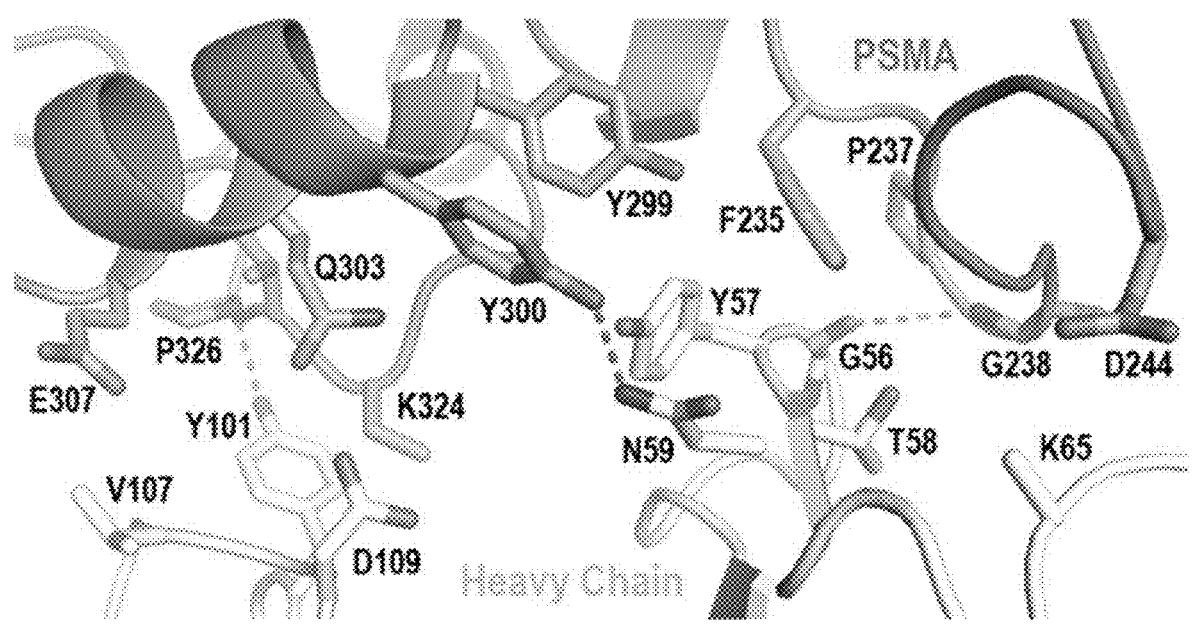

FIG. 27 shows a close view of PSMA main interactions with the PSMB83 Heavy Chain FIG. 28 shows the comparison of epitope residues of PSMB83 within the sequences of human (SEQ ID NO: 719), mouse (SEQ ID NO: 720) and cynomolgus monkey (cyno) (SEQ ID NO: 721) PSMA. Epitope residues are shaded and sequence divergence is shown by underline.

Figure 30:
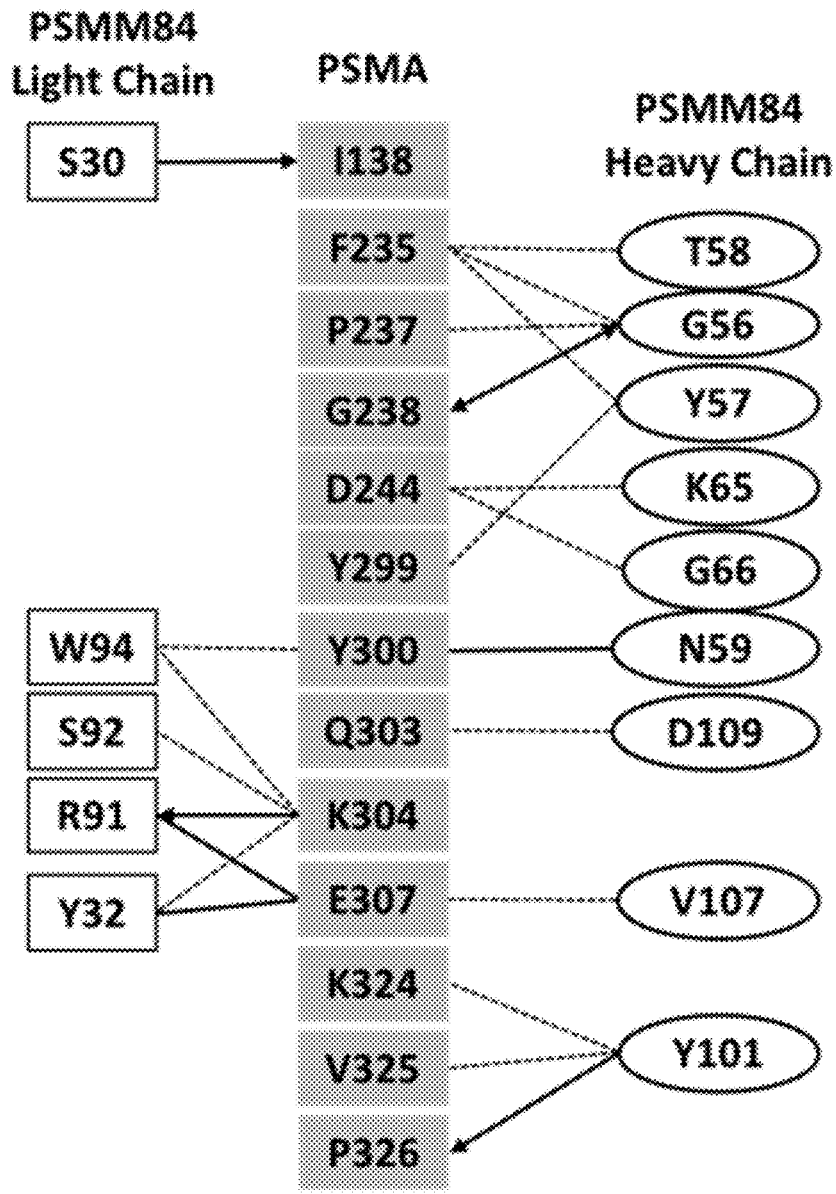

FIG. 29 shows the paratope residues of PSMB83. CDRs are underlined and paratope residues are shaded. FIG. 30 discloses SEQ ID NOS 722-727, respectively, in order of appearance.

FIG. 30 shows an interaction map with direct contacts made between PSMA and PSMM84. Van der Waals interactions are shown as dashed lines and H-bonds are solid lines with arrows pointing to the backbone atoms.

Figure 31:
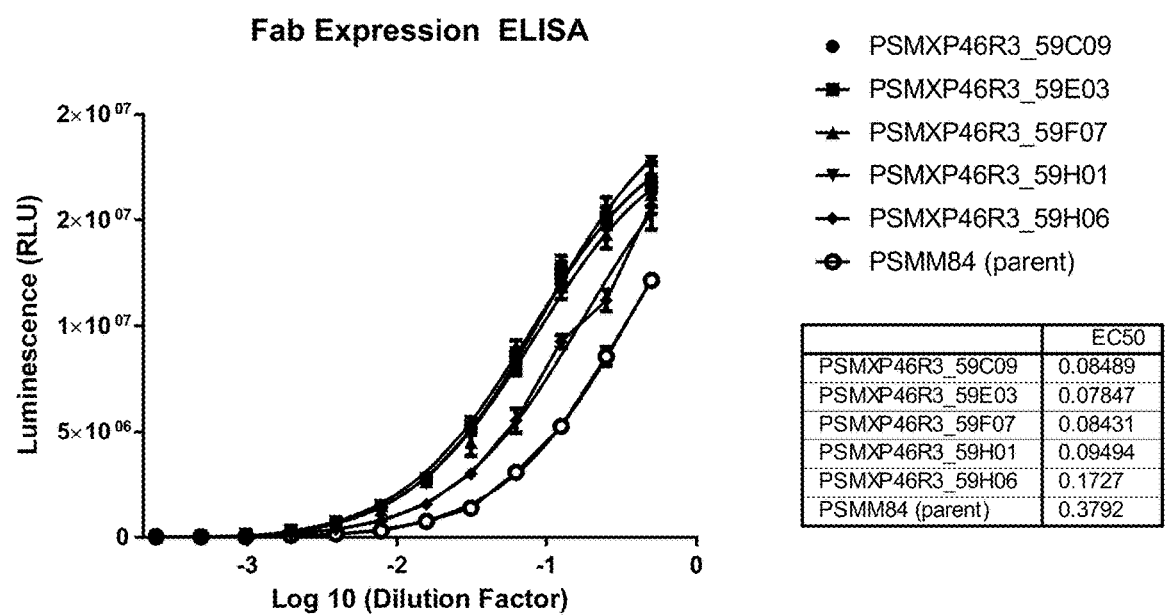
Figure 32:
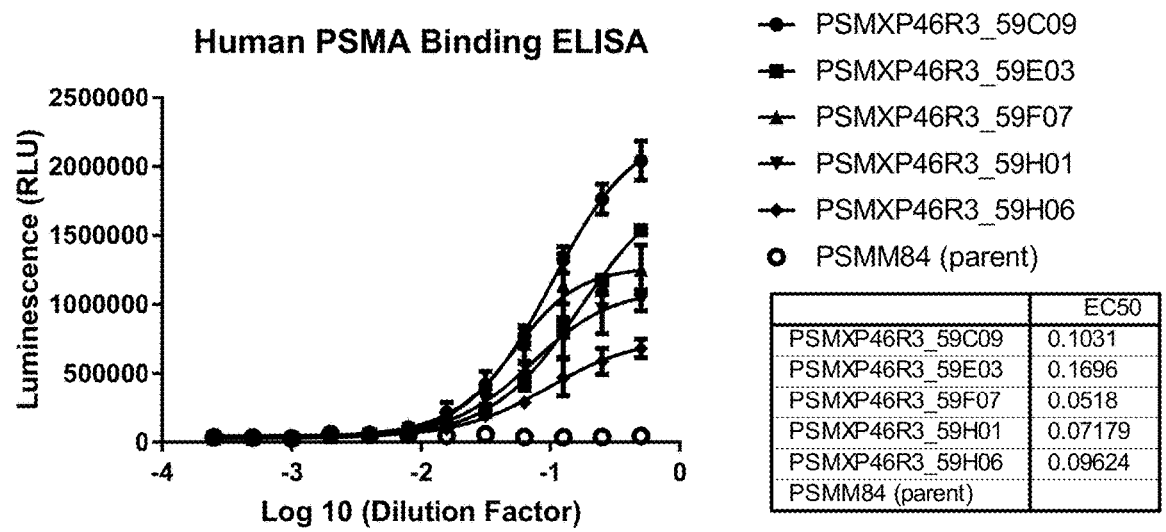

FIG. 31 shows expression levels of anti-PSMA Fab clones derived from PSMM84 as compared to expression of parent PSMB83. Raw luminescence numbers were plotted against the log concentration FIG. 32 shows binding to human PSMA of anti-PSMA Fab clones derived from PSMB83 as compared to binding of parent PSMM84. Raw luminescence numbers were plotted against the log concentration.

Figure 33:
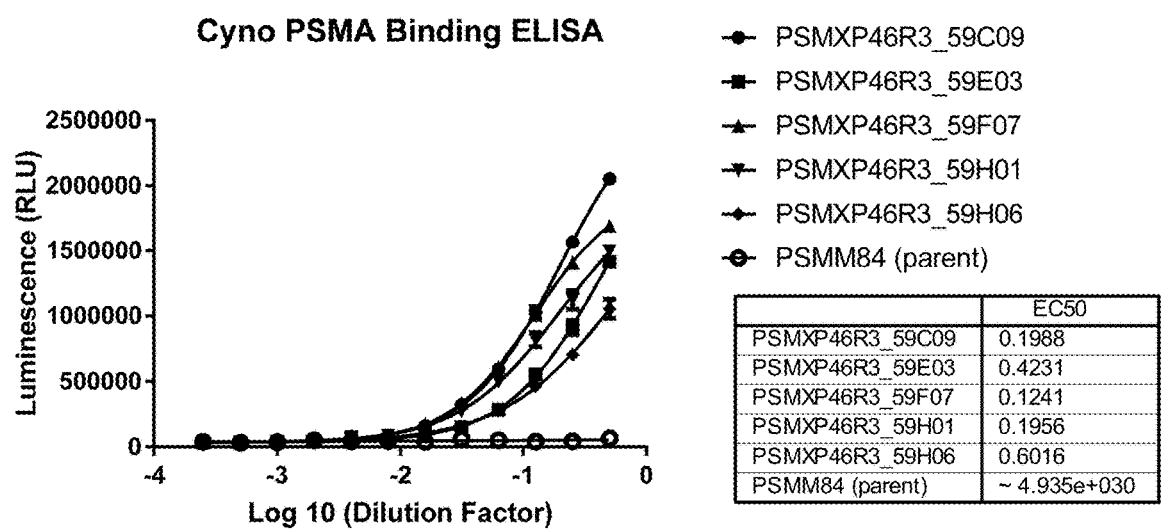

FIG. 33 shows binding to cyno PSMA of anti-PSMA Fab clones derived from PSMB83 as compared to binding of parent PSMB83. Raw luminescence numbers were plotted against the log concentration.

Figure 34:
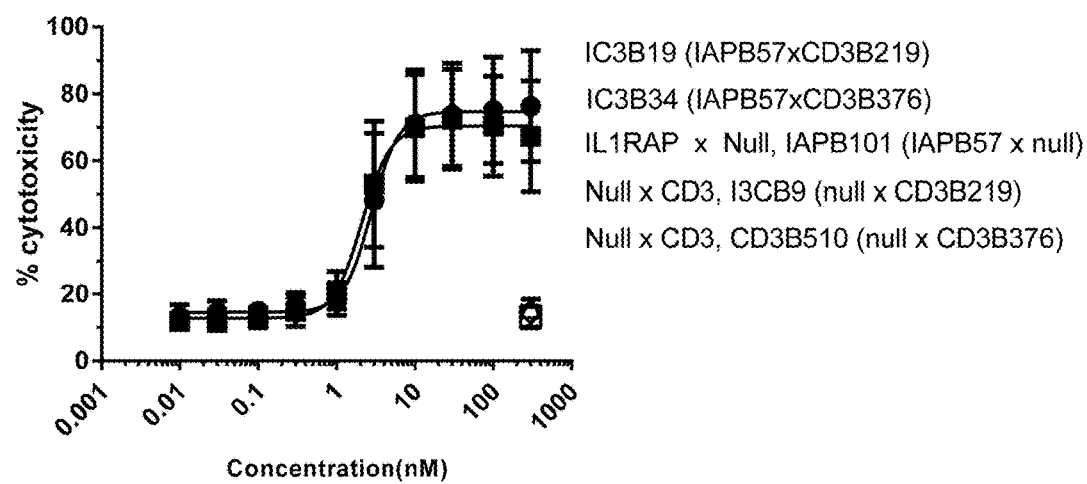

FIG. 34 shows IC3B19 and IC3B34 Ex Vivo Mediated T cell Cytotoxicity of LAMA-84 cells in Whole Blood after 48 hours. The concentration of IC3B19 and IC3B34 is provided in the table in the lower part of the figure.

Figure 35:
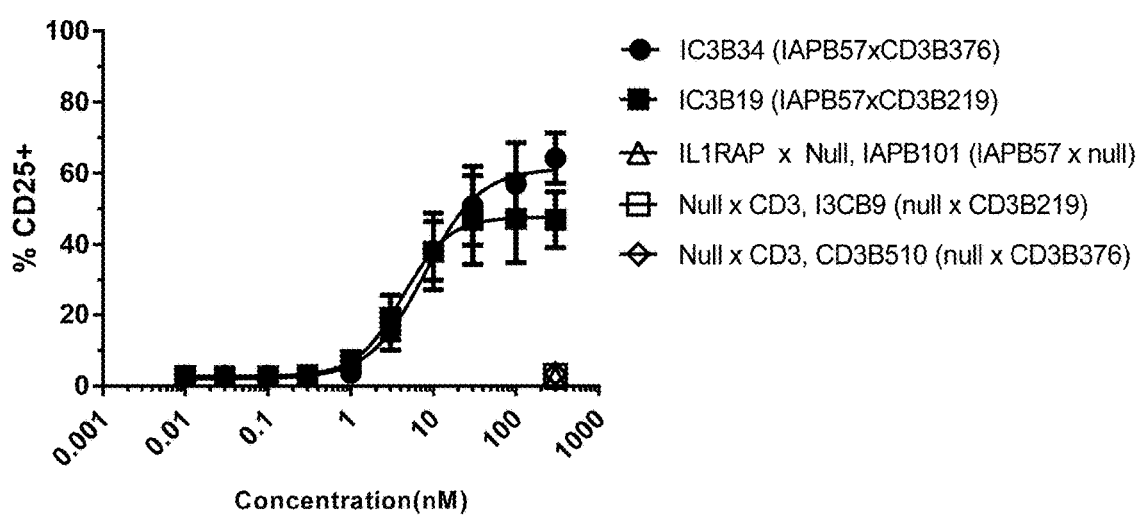

FIG. 35 shows IC3B19 and IC3B34 Ex Vivo Mediated T-cell Activation in Whole Blood after 48 hours. The concentration of IC3B19 and IC3B34 is provided in the table in the lower part of the figure.

FIGS. 36A-55B (descriptions below) show IC3B19 and IC3B34 mediated engagement of T cells and IL1RAP+ target cell line LAMA-84 (endogenous and exogenously added tumor cells). Supernatants were evaluated for 10 pro-inflammatory cytokines from whole blood (n=15 donors) cytotoxicity and T-cell activation assays with exogenous LAMA-84 IL1RAP+ tumor cell line added. For these figures, statistically significant differences are shown in bold text.

Figure 36A:
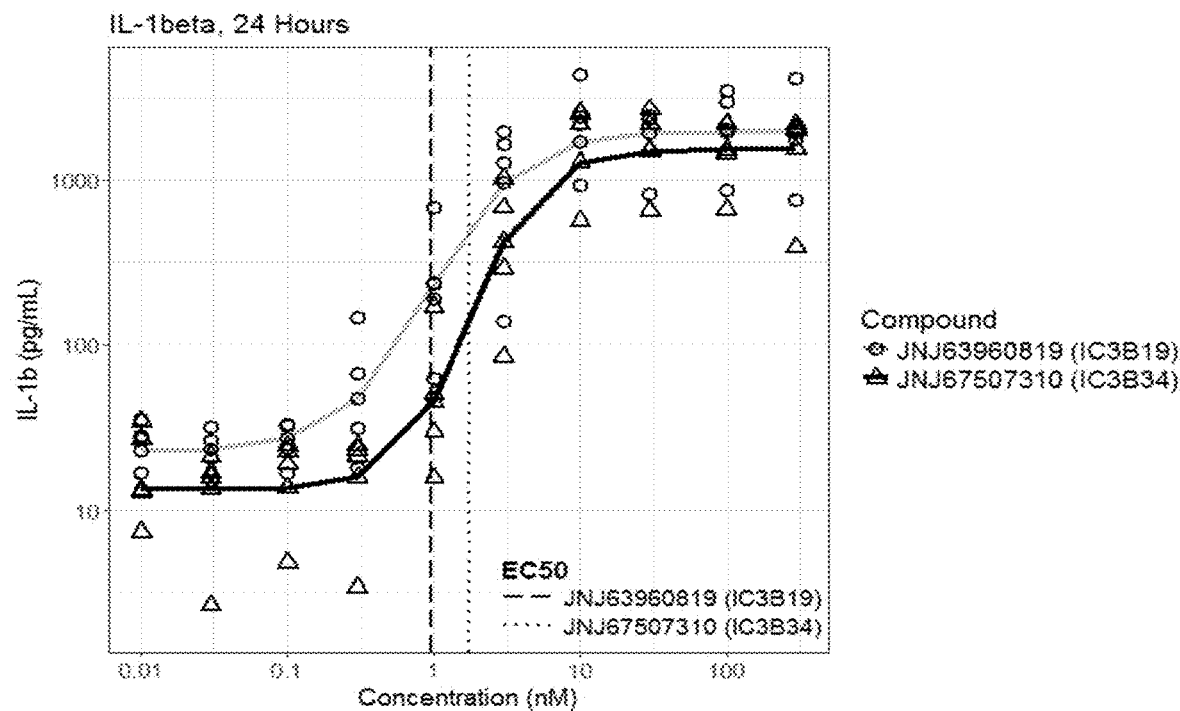
Figure 36B:
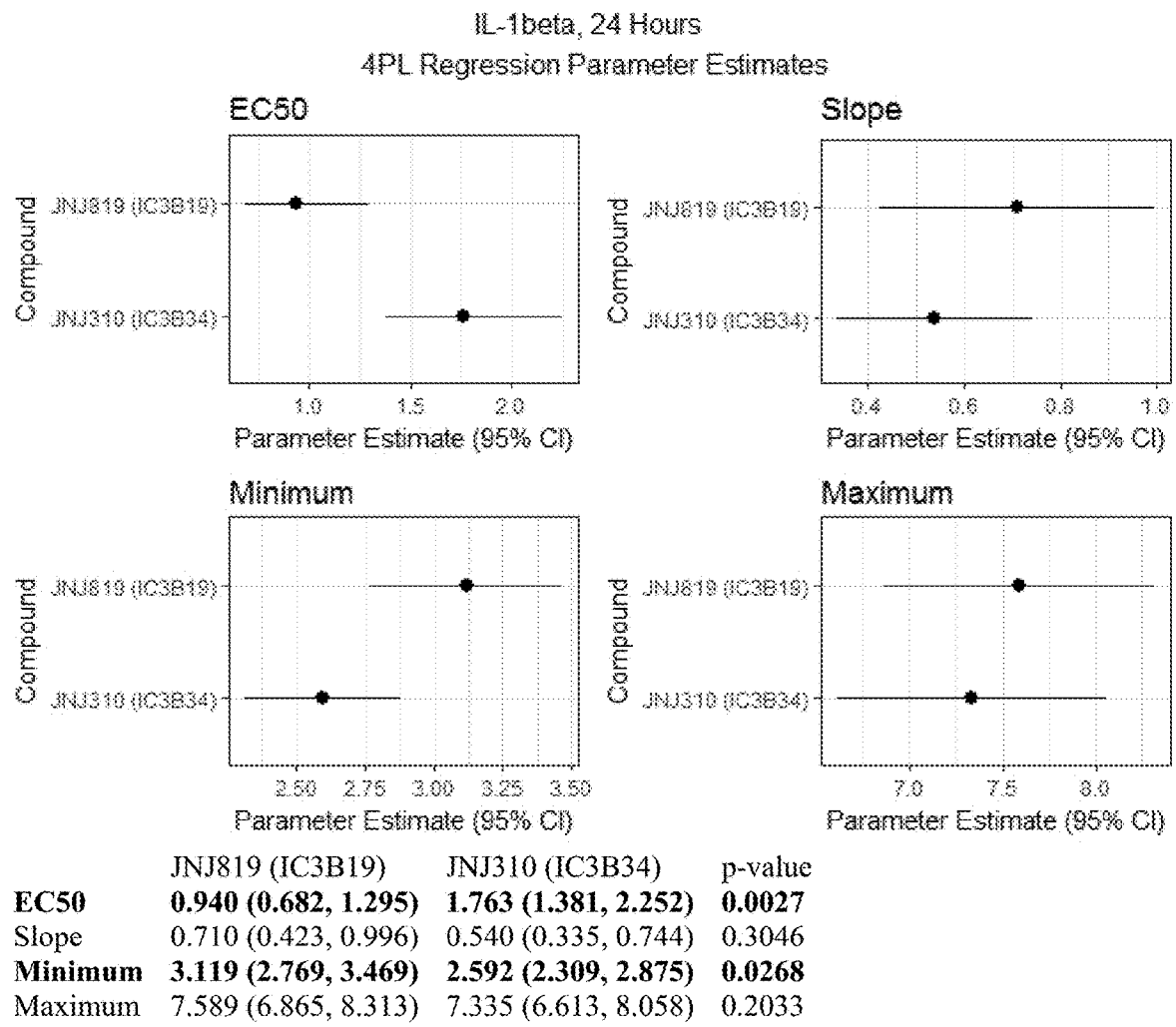

FIGS. 36A-36B show T cell IL-1beta release mediated by IC3B19 and IC3B34 (FIG. 36A) and corresponding 4PL regression parameter estimates (FIG. 36B) after 24 hours.

Figure 37A:
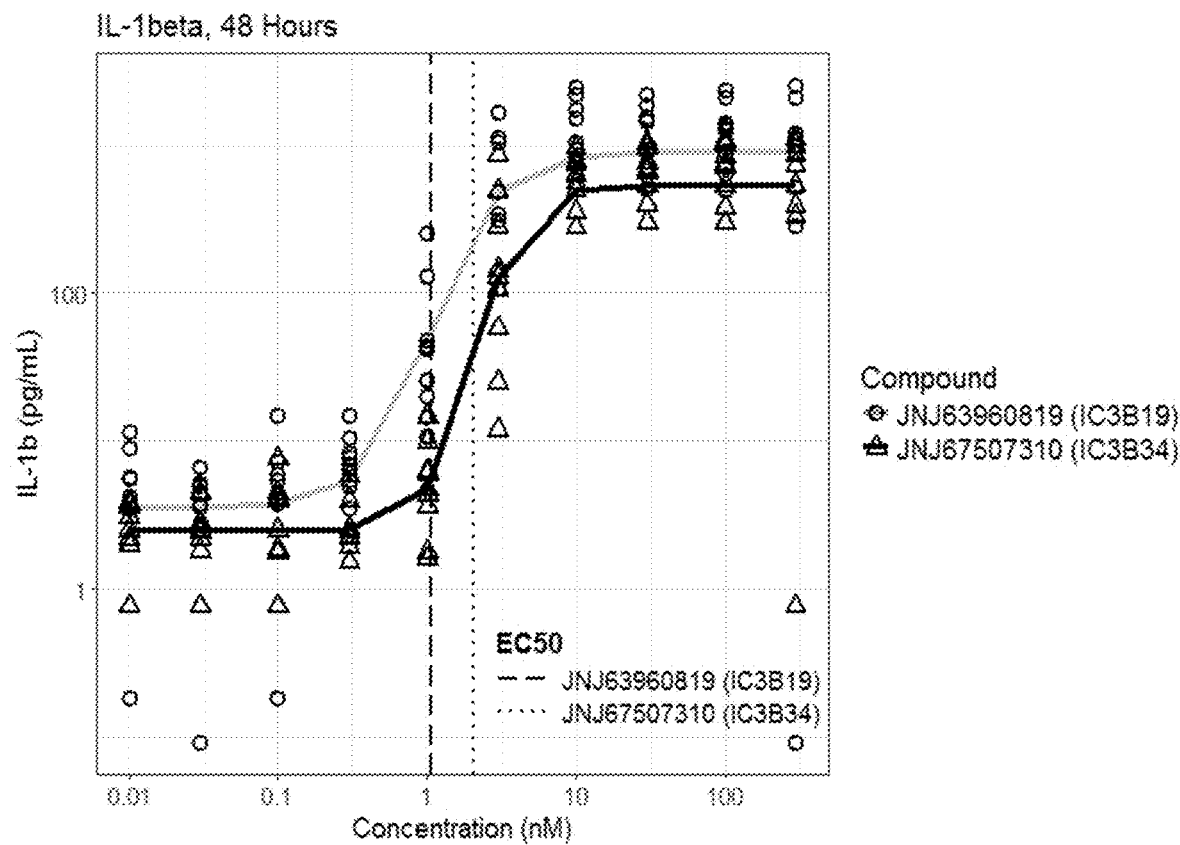
Figure 37B:
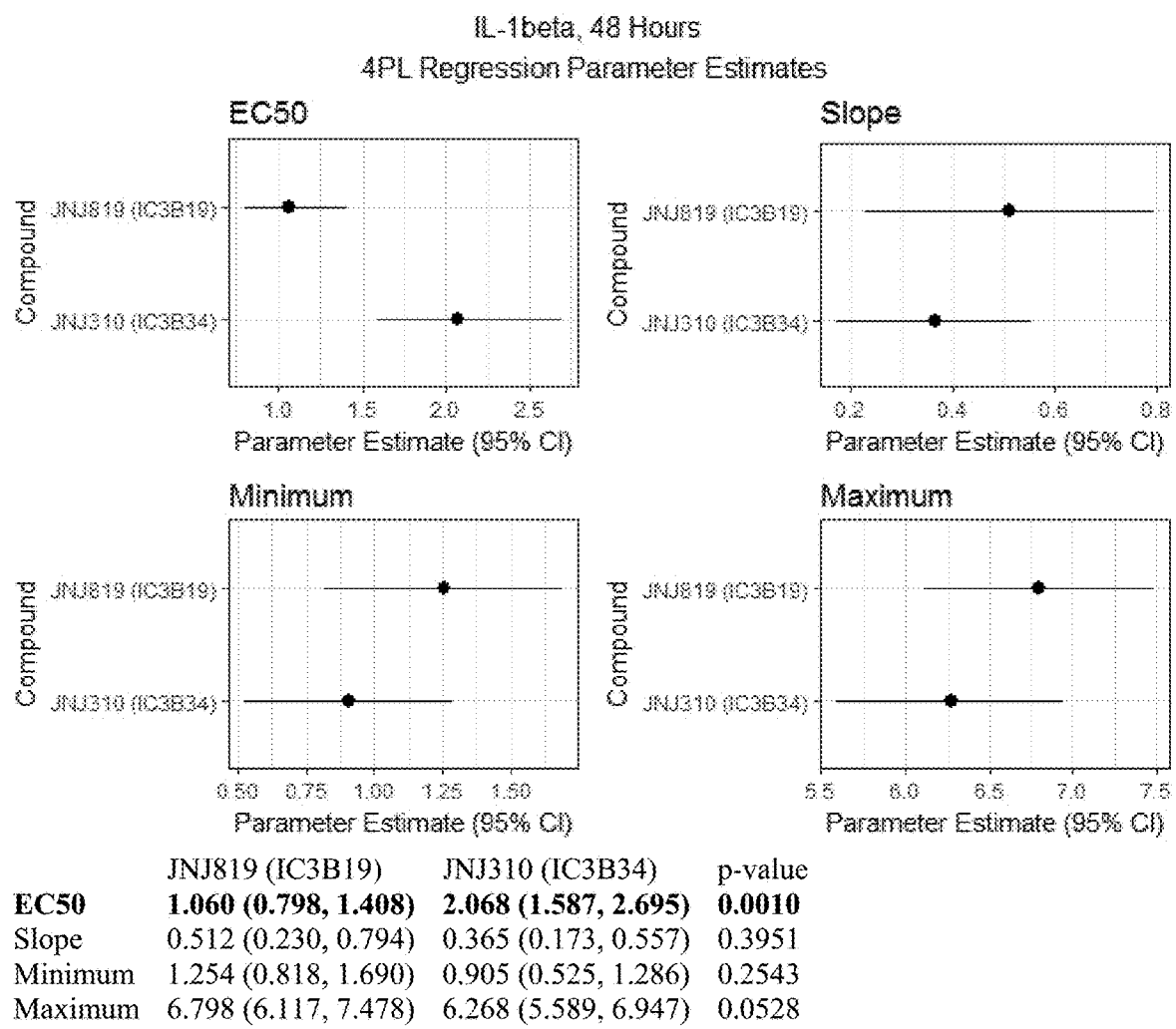

FIGS. 37A-37B show T cell IL-1beta release mediated by IC3B19 and IC3B34 (FIG. 37A) and corresponding 4PL regression parameter estimates (FIG. 37B) after 48 hours.

Figure 38A:
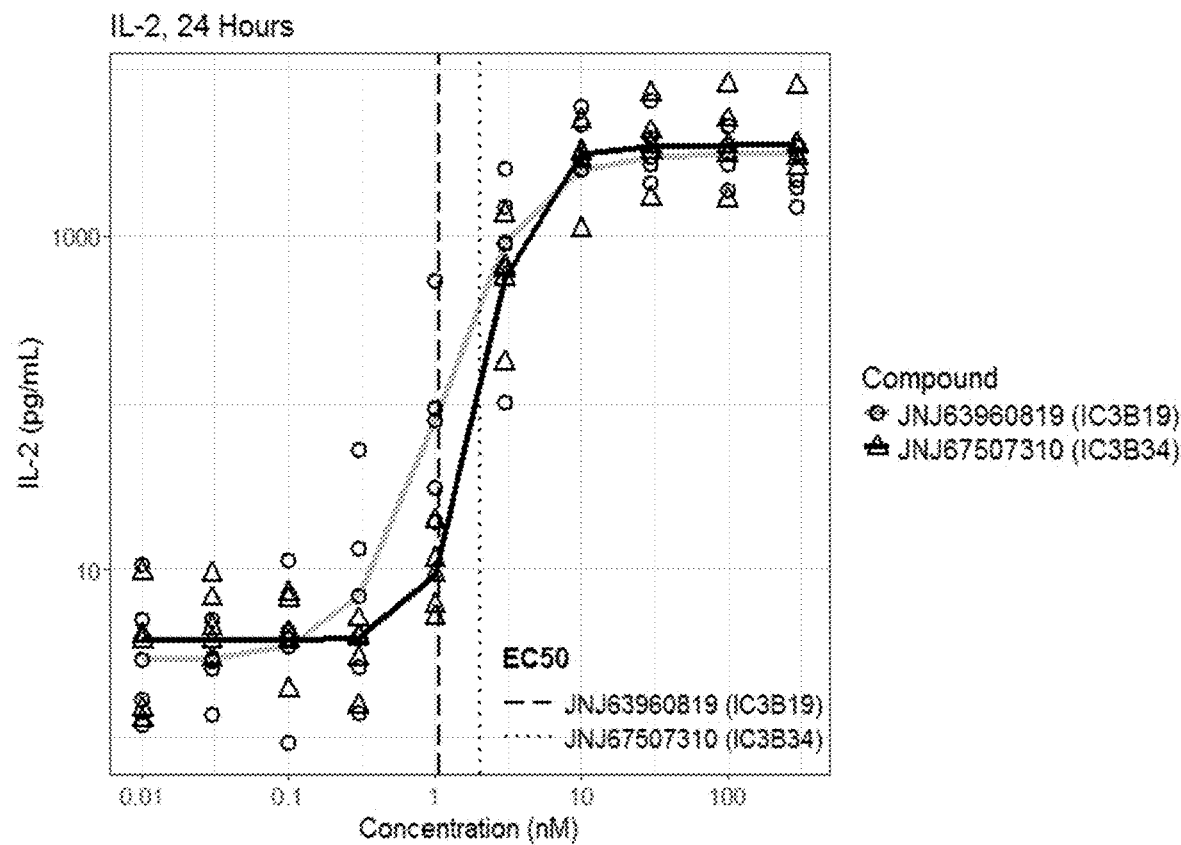
Figure 38B:
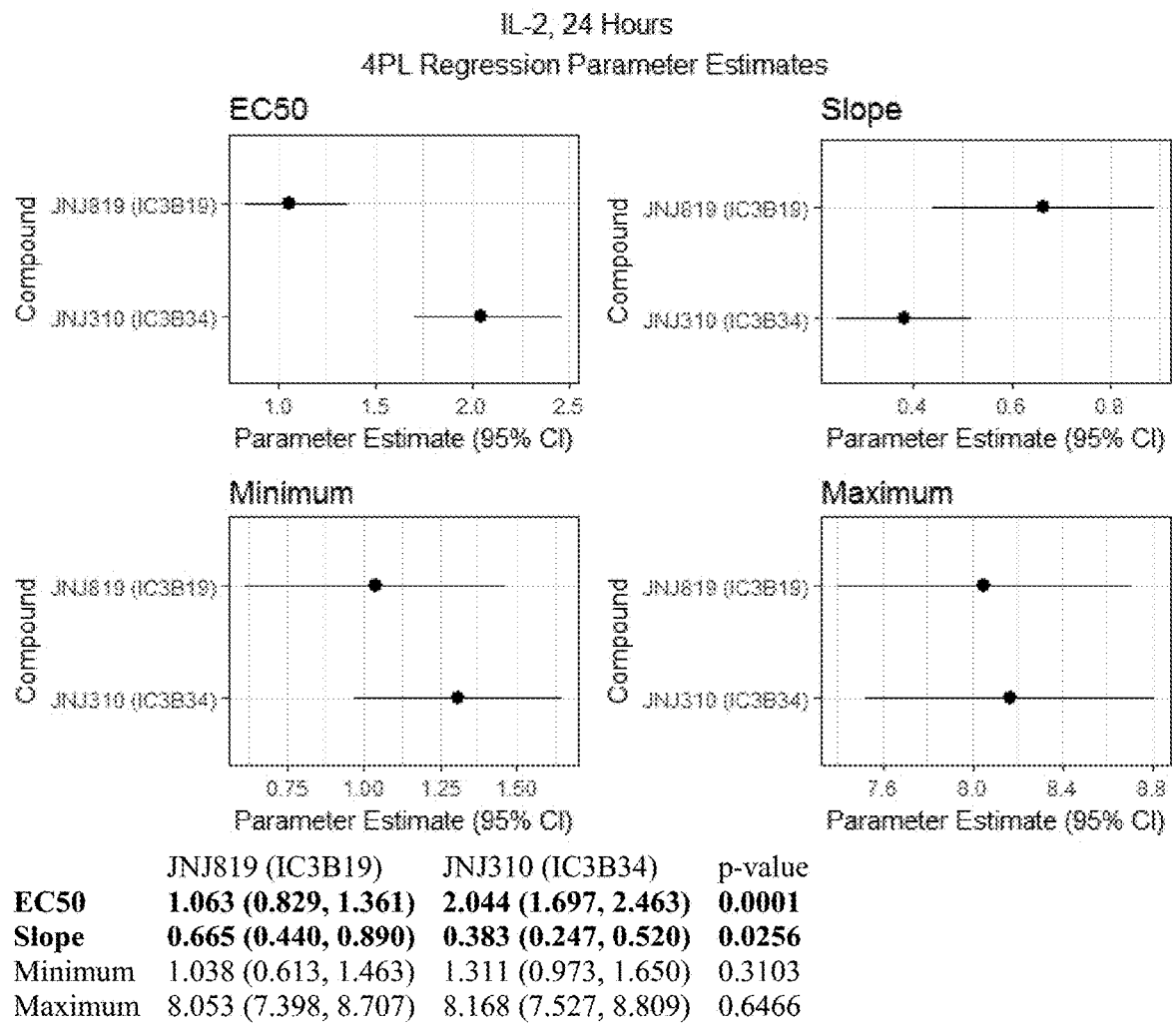

FIGS. 38A-38B show T cell IL-2 release mediated by IC3B19 and IC3B34 (FIG. 38A) and corresponding 4PL regression parameter estimates (FIG. 38B) after 24 hours.

Figure 39A:
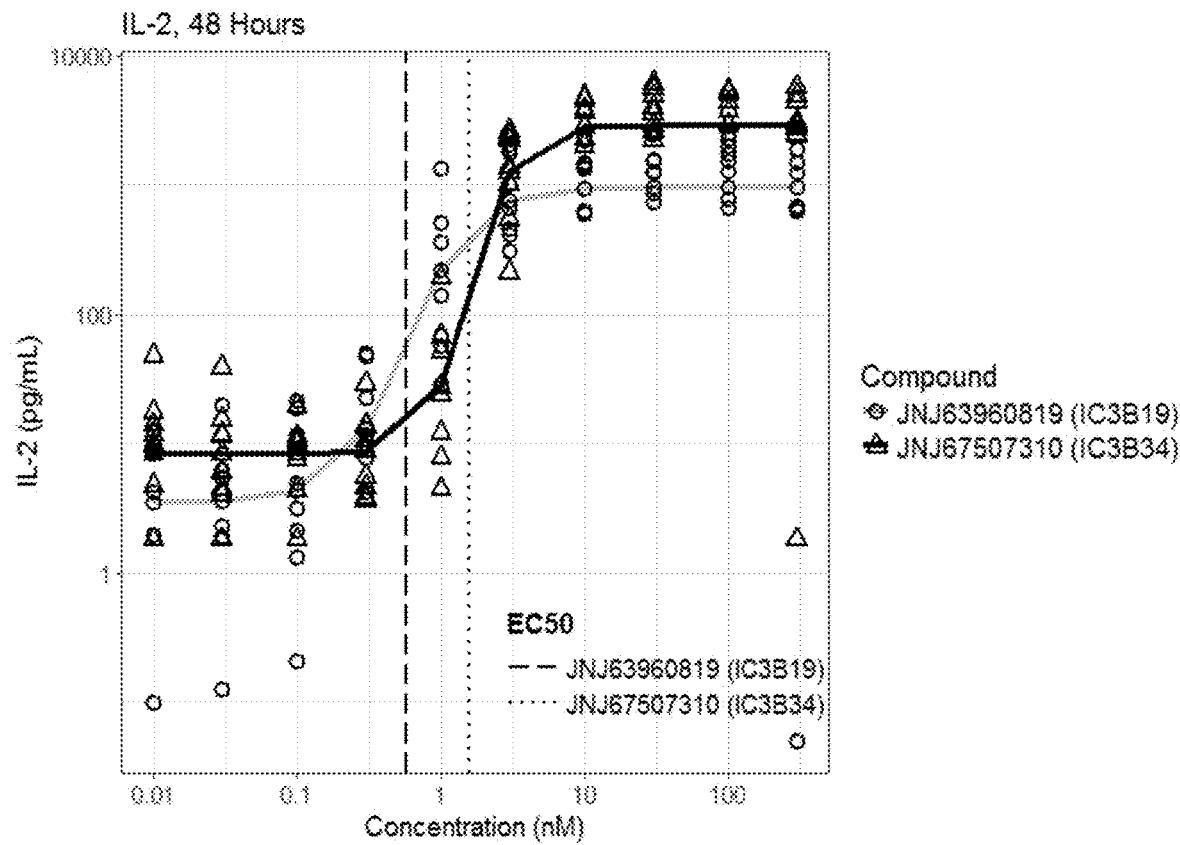
Figure 39B:
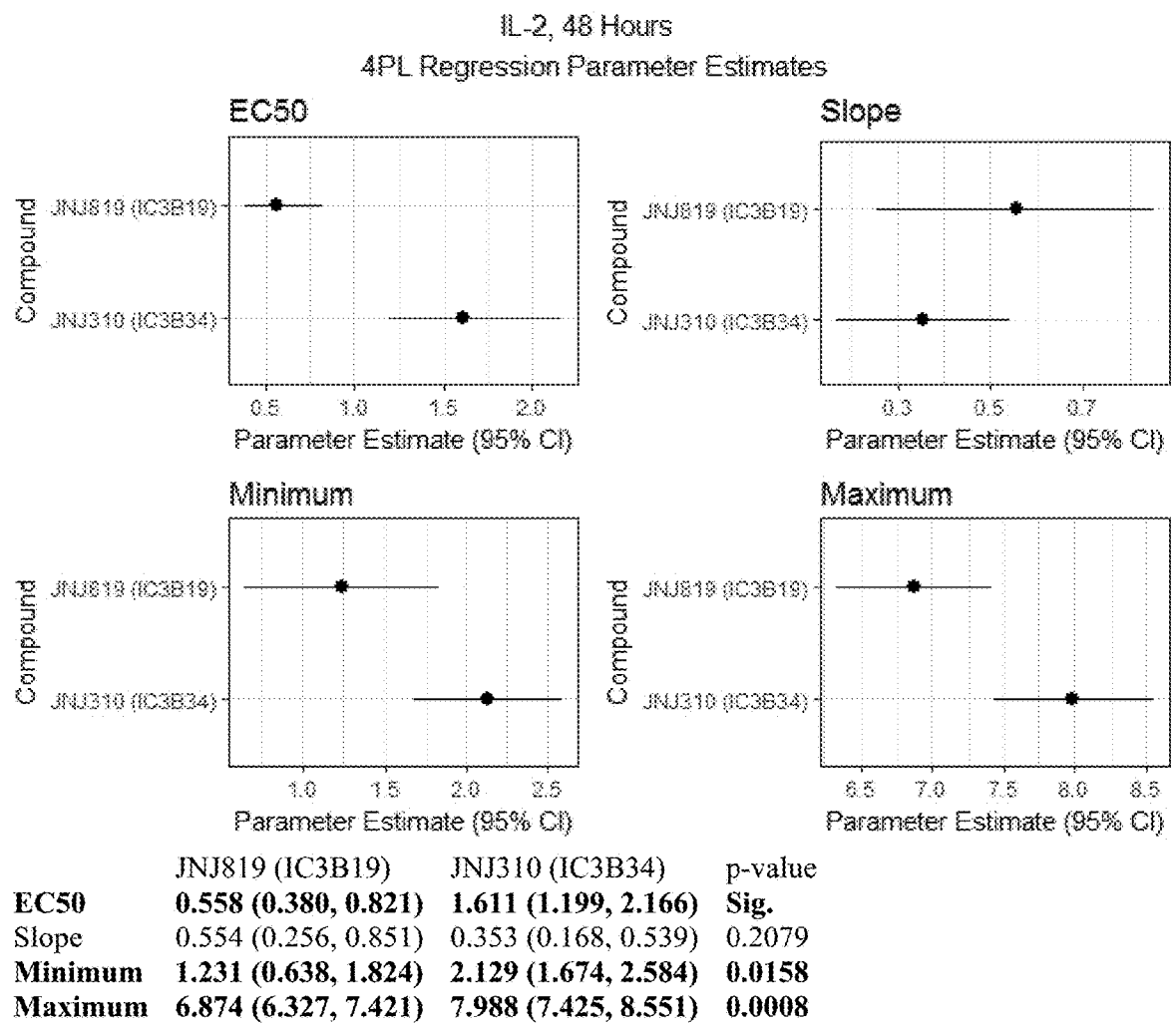

FIGS. 39A-39B show T cell IL-2 release mediated by IC3B19 and IC3B34 (FIG. 39A) and corresponding 4PL regression parameter estimates (FIG. 39B) after 48 hours.

Figure 40A:
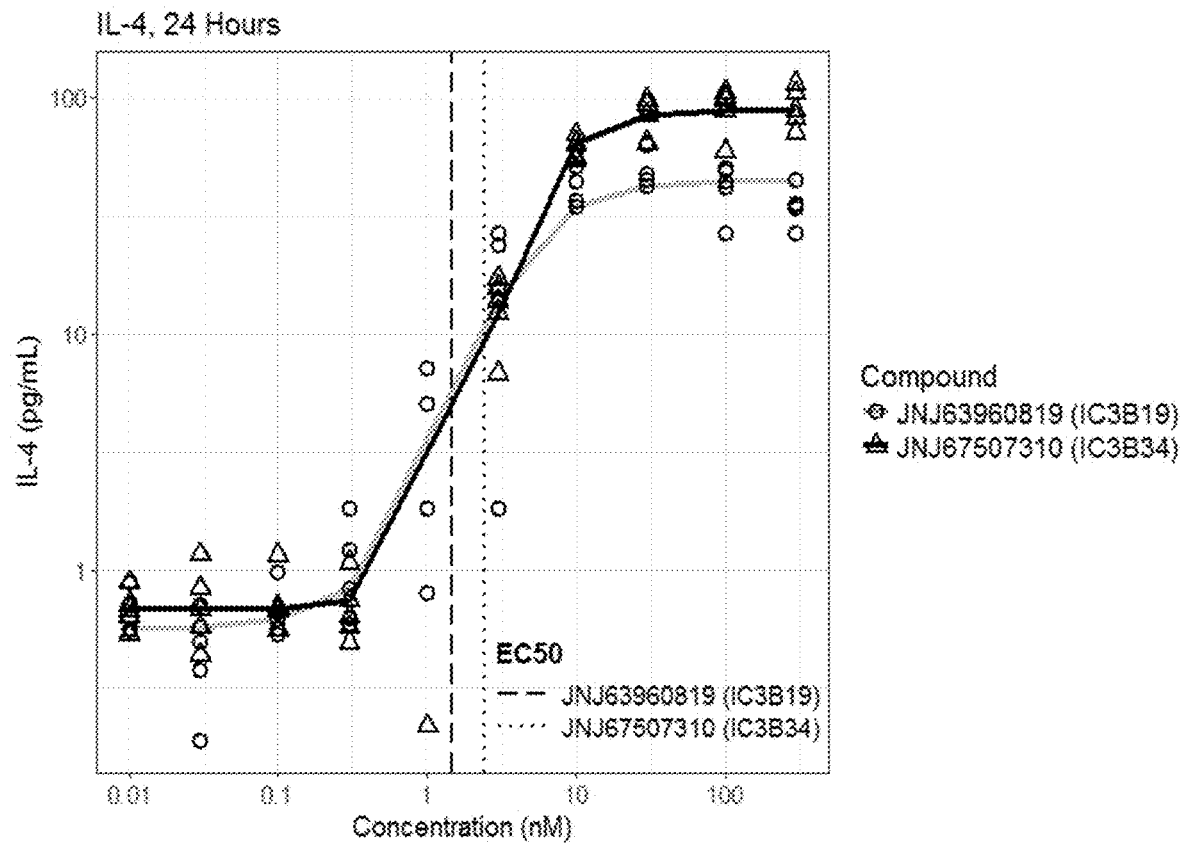
Figure 40B:
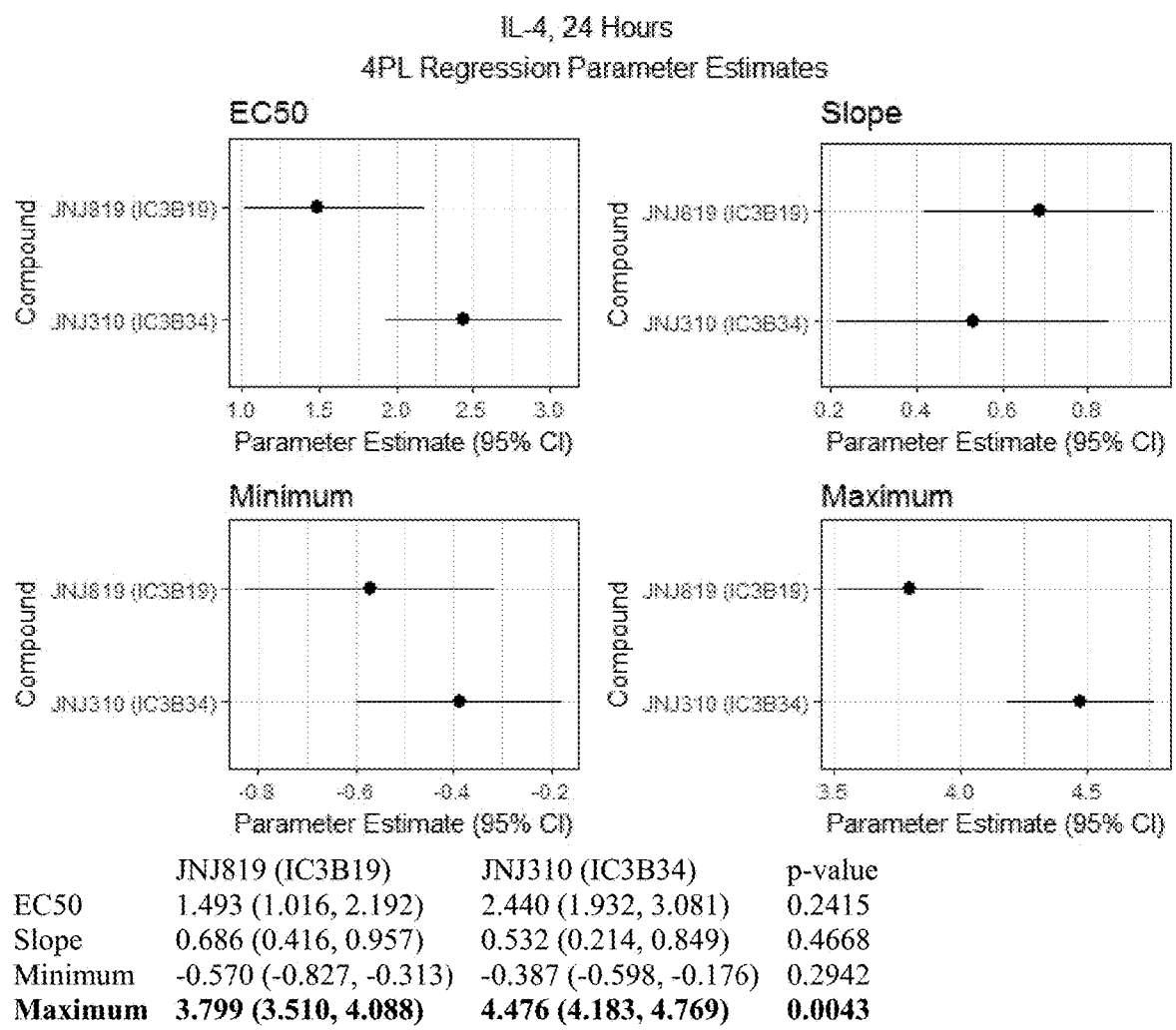

FIGS. 40A-40B show T cell IL-4 release mediated by IC3B19 and IC3B34 (FIG. 40A) and corresponding 4PL regression parameter estimates (FIG. 40B) after 24 hours.

Figure 41:
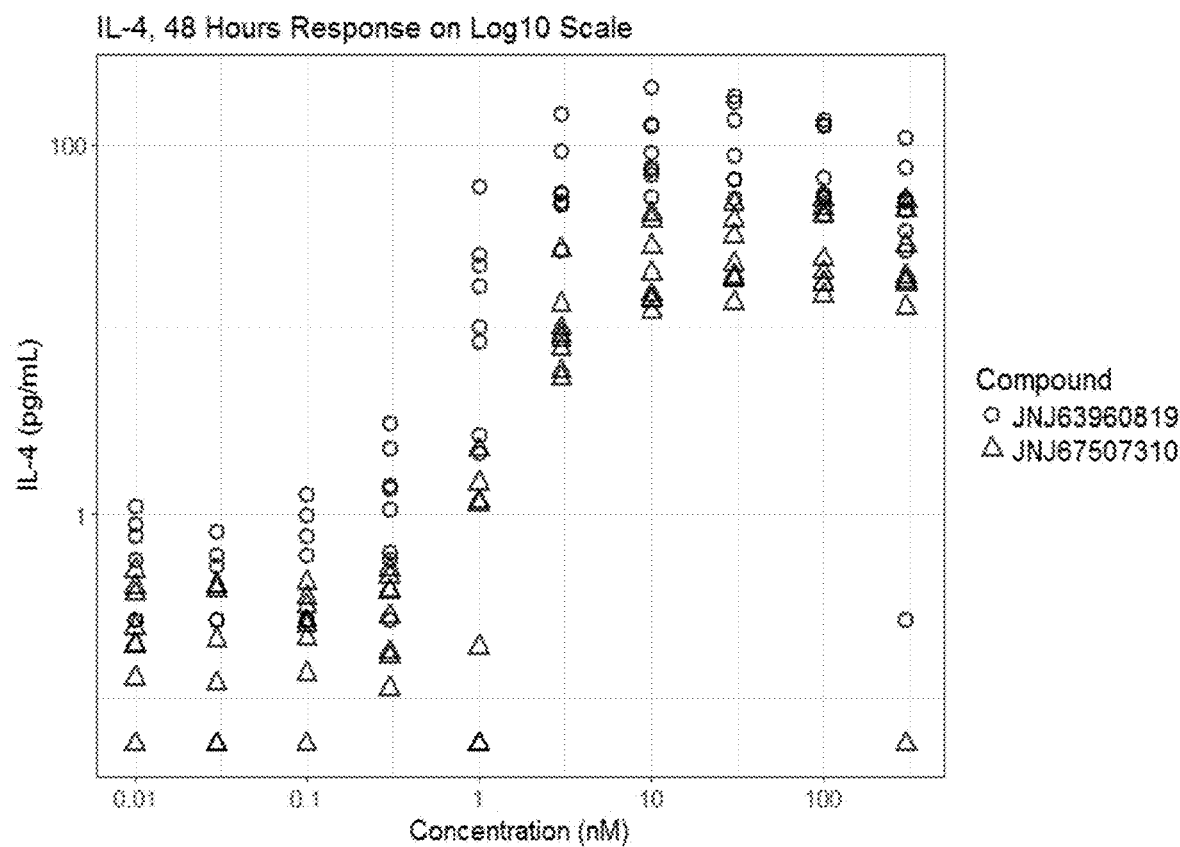

FIG. 41 shows T cell IL-4 release mediated by IC3B19 and IC3B34 after 48 hours.

Figure 42A:
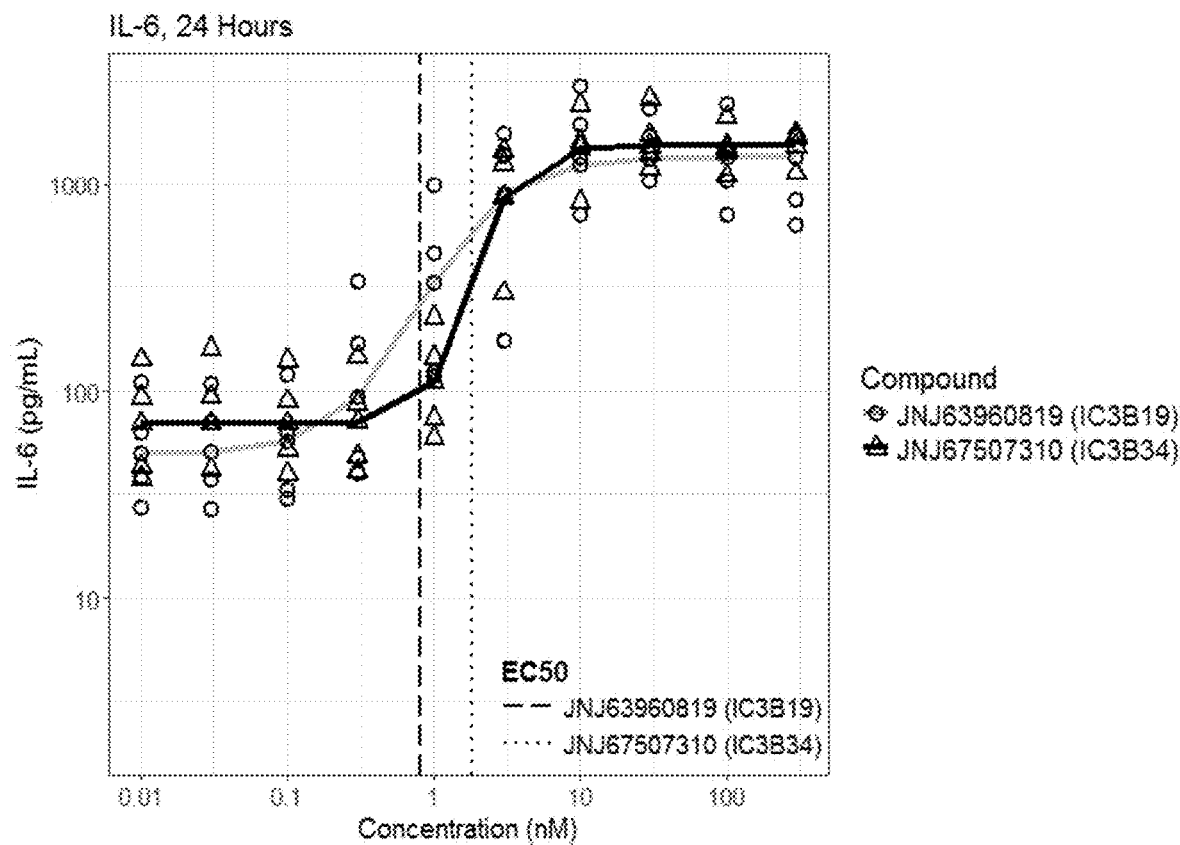
Figure 42B:
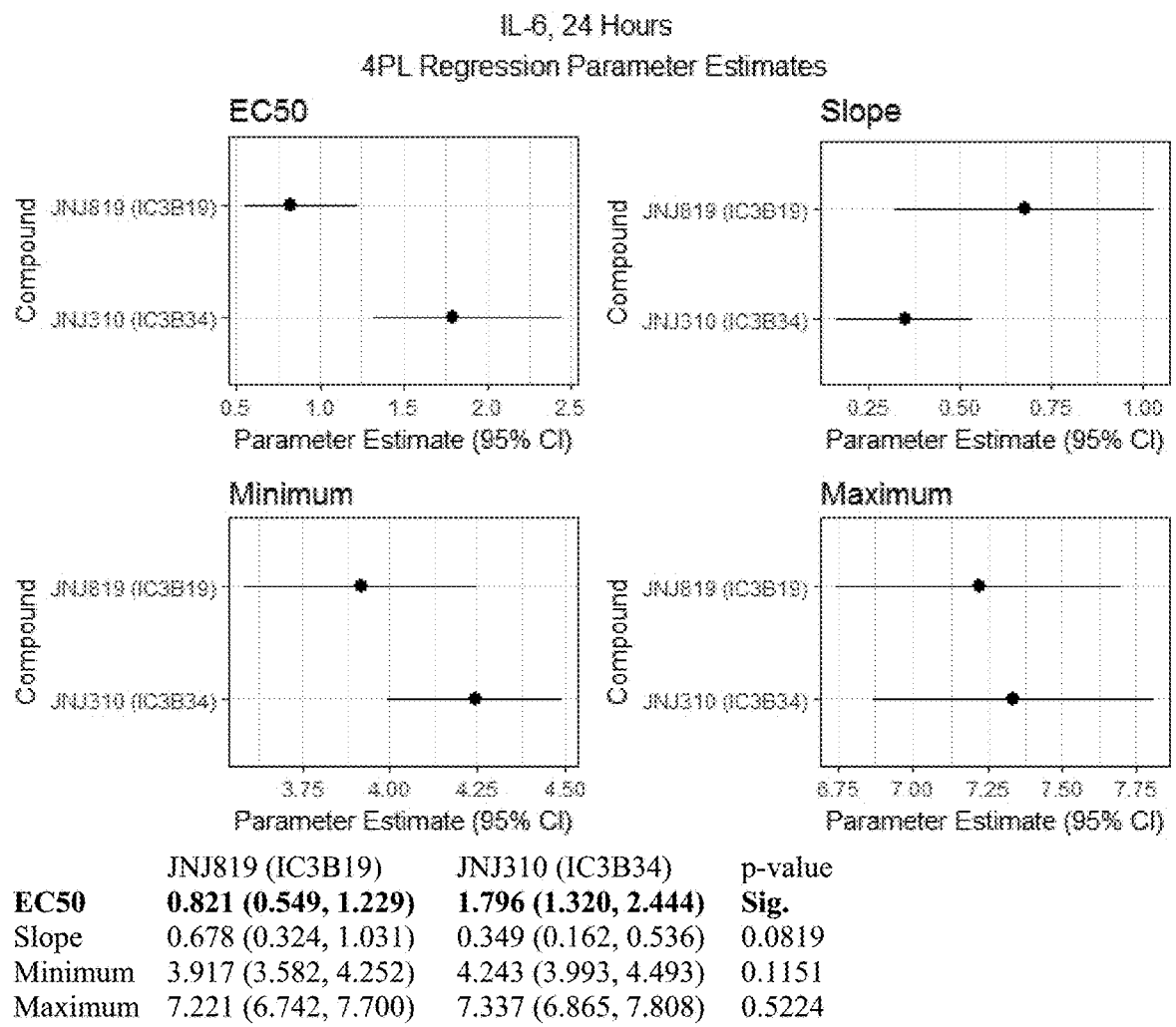

FIGS. 42A-42B show T cell IL-6 release mediated by IC3B19 and IC3B34 (FIG. 42A) and corresponding 4PL regression parameter estimates (FIG. 42B) after 24 hours.

Figure 43:
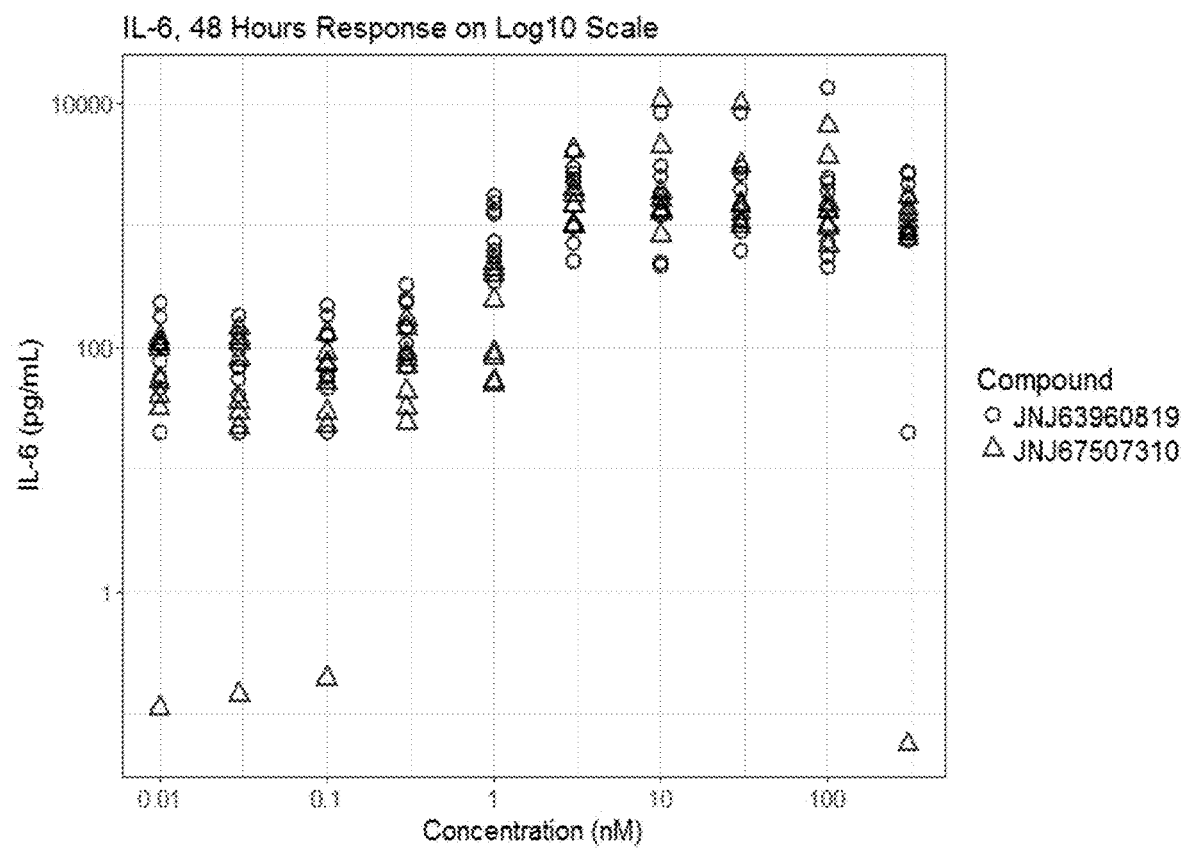

FIG. 43 shows T cell IL-6 release mediated by IC3B19 and IC3B34 after 48 hours.

Figure 44:
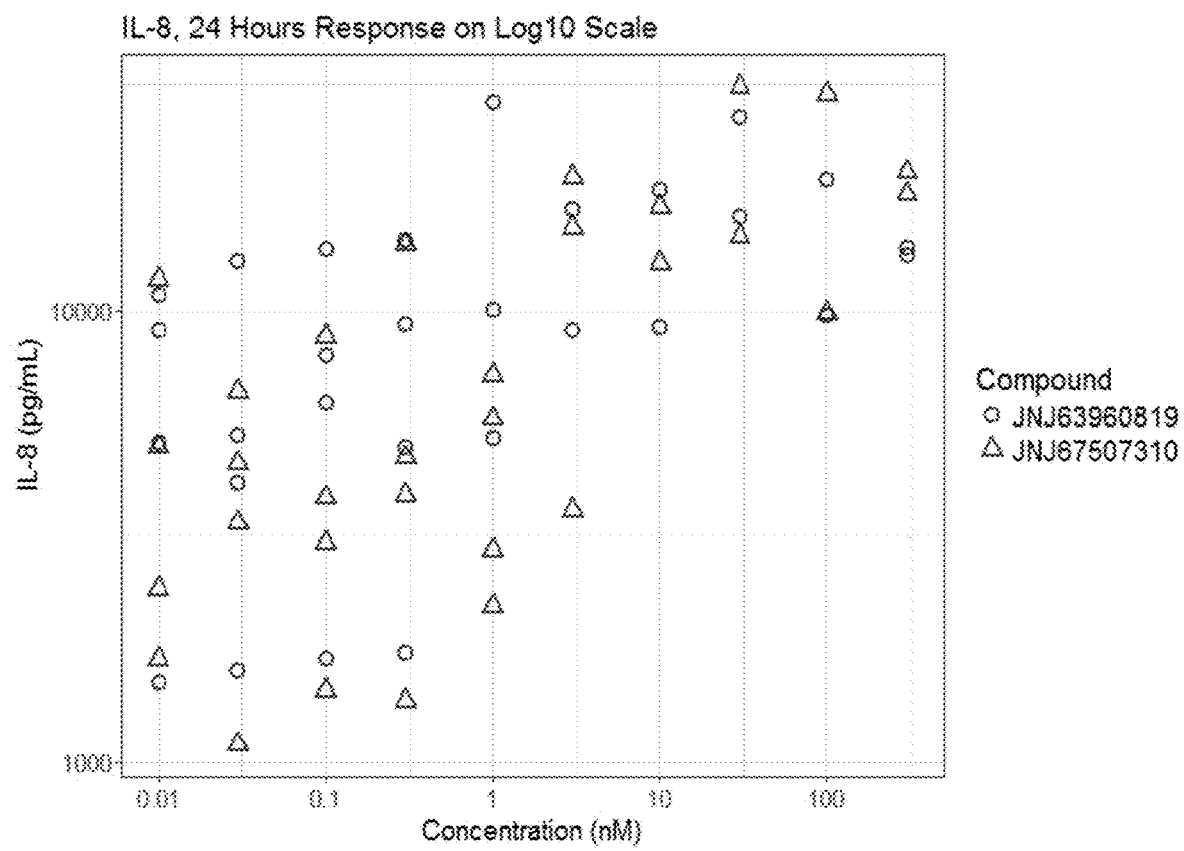

FIG. 44 shows T cell IL-8 release mediated by IC3B19 and IC3B34 after 24 hours.

Figure 45:
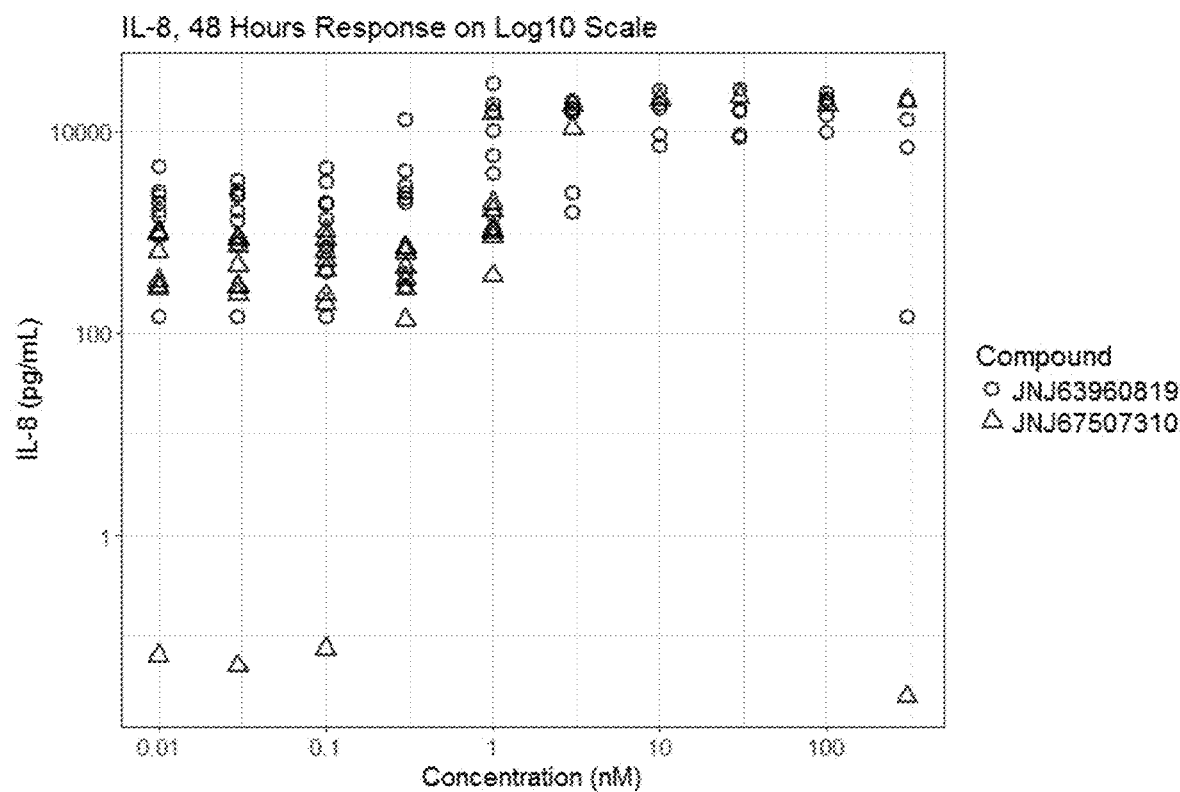

FIG. 45 shows T cell IL-8 release mediated by IC3B19 and IC3B34 after 48 hours.

Figure 46A:
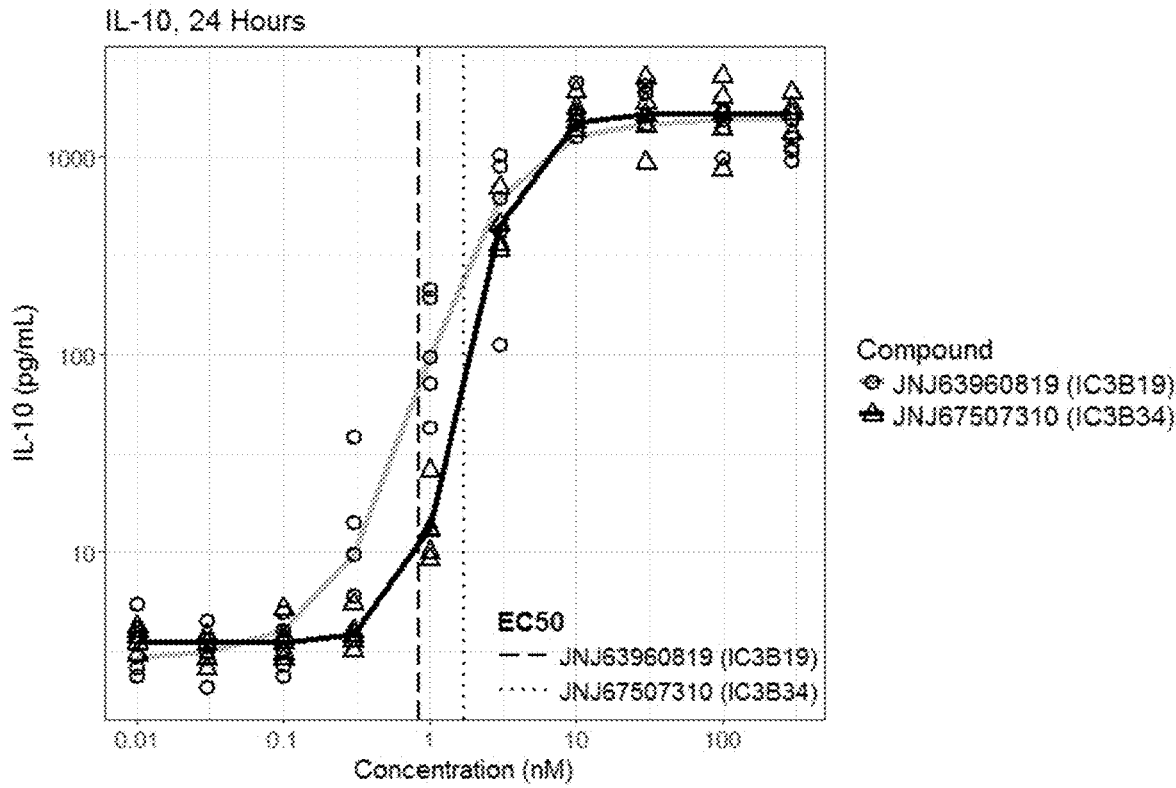
Figure 46B:
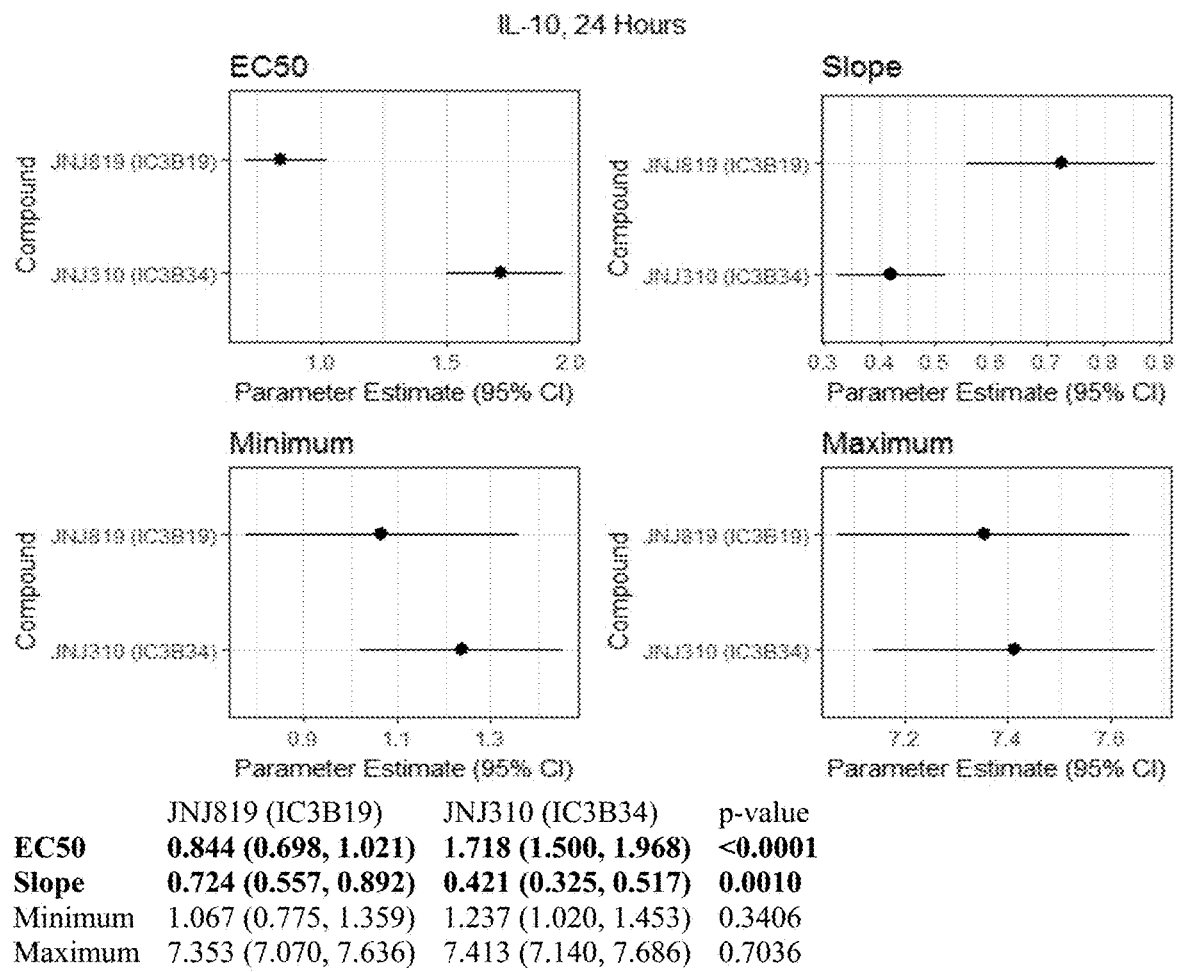

FIGS. 46A-46B show T cell IL-10 release mediated by IC3B19 and IC3B34 (FIG. 46A) and corresponding 4PL regression parameter estimates (FIG. 46B) after 24 hours.

Figure 47A:
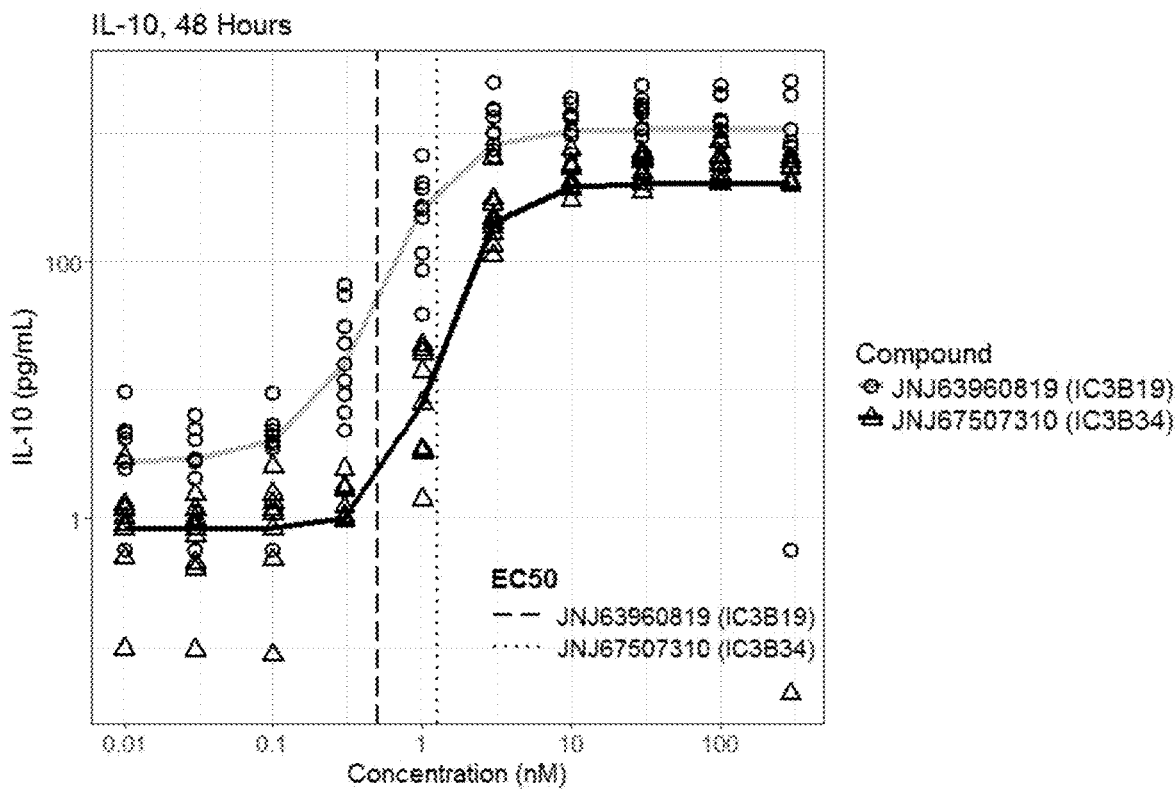
Figure 47B:
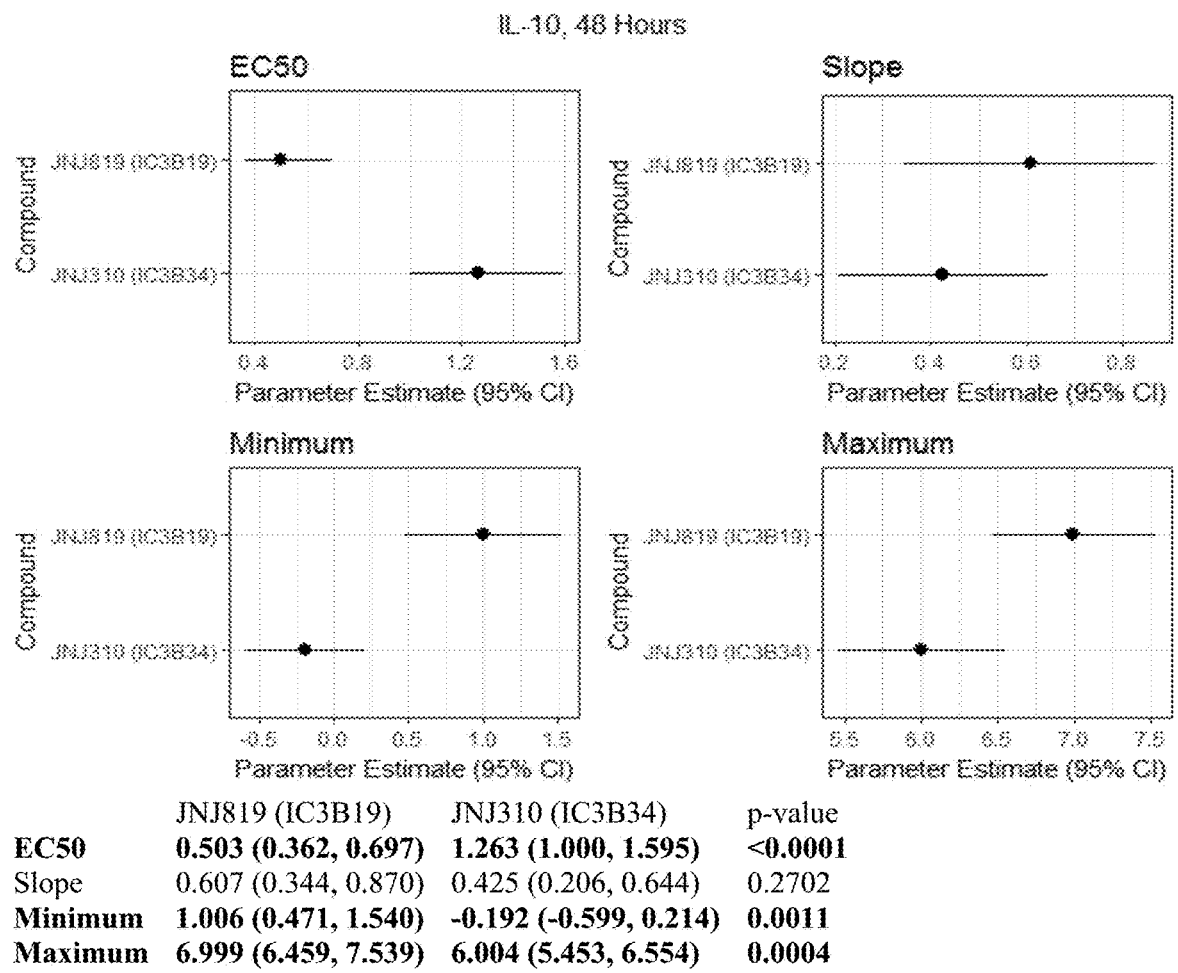

FIGS. 47A-47B show T cell IL-10 release mediated by IC3B19 and IC3B34 (FIG. 47A) and corresponding 4PL regression parameter estimates (FIG. 47B) after 48 hours.

Figure 48:
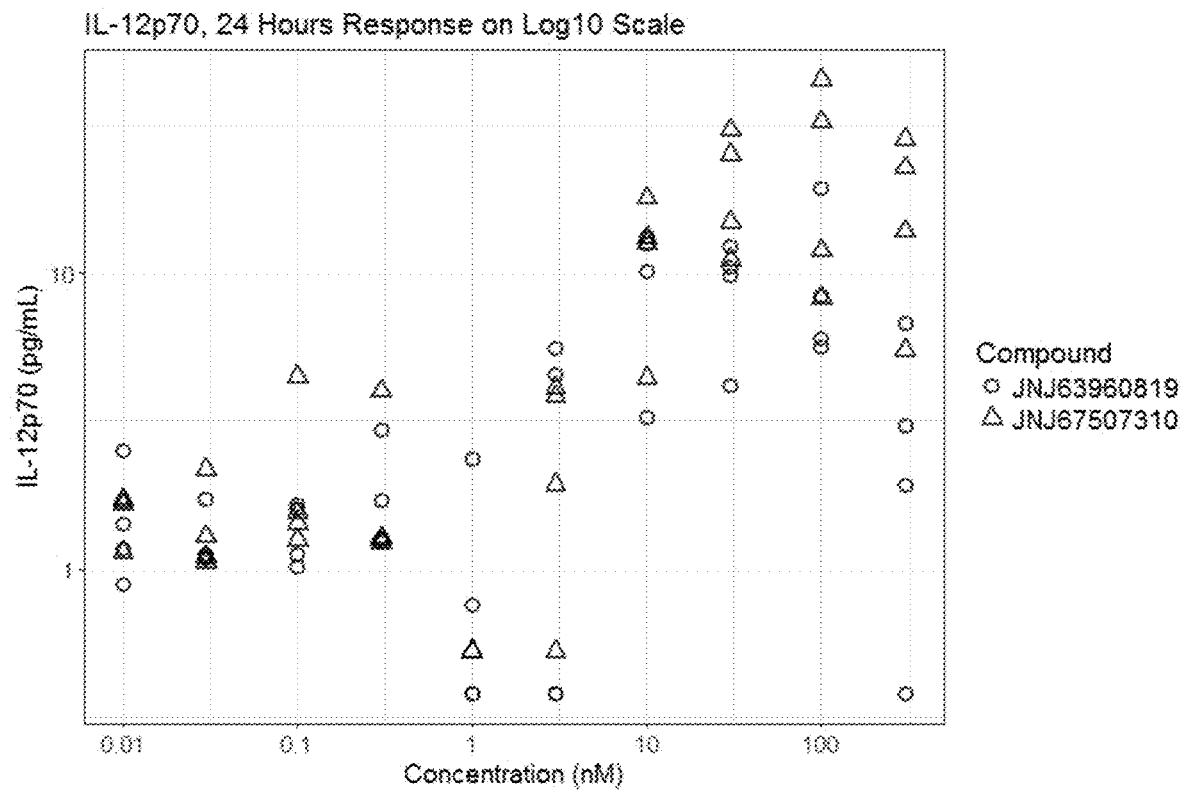

FIG. 48 shows T cell IL-12p70 release mediated by IC3B19 and IC3B34 after 24 hours.

Figure 49:
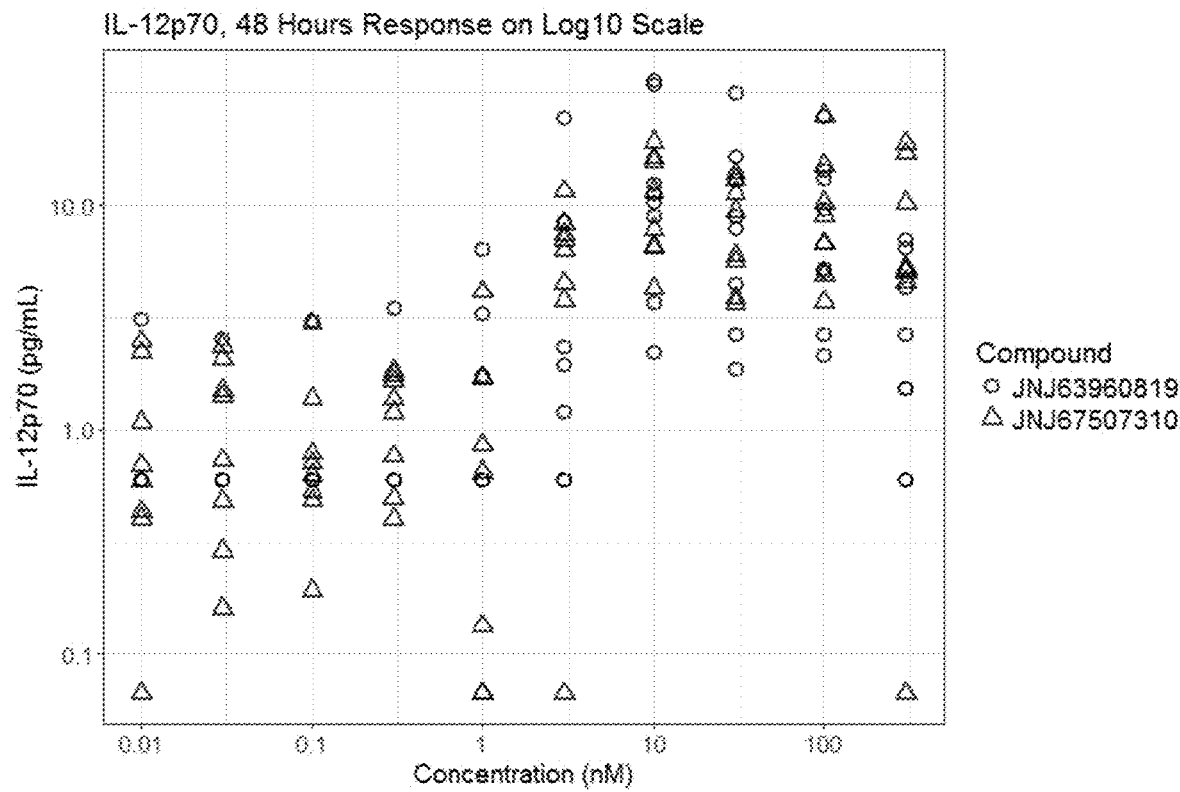

FIG. 49 shows T cell IL-12p70 release mediated by IC3B19 and IC3B34 after 48 hours.

Figure 50:
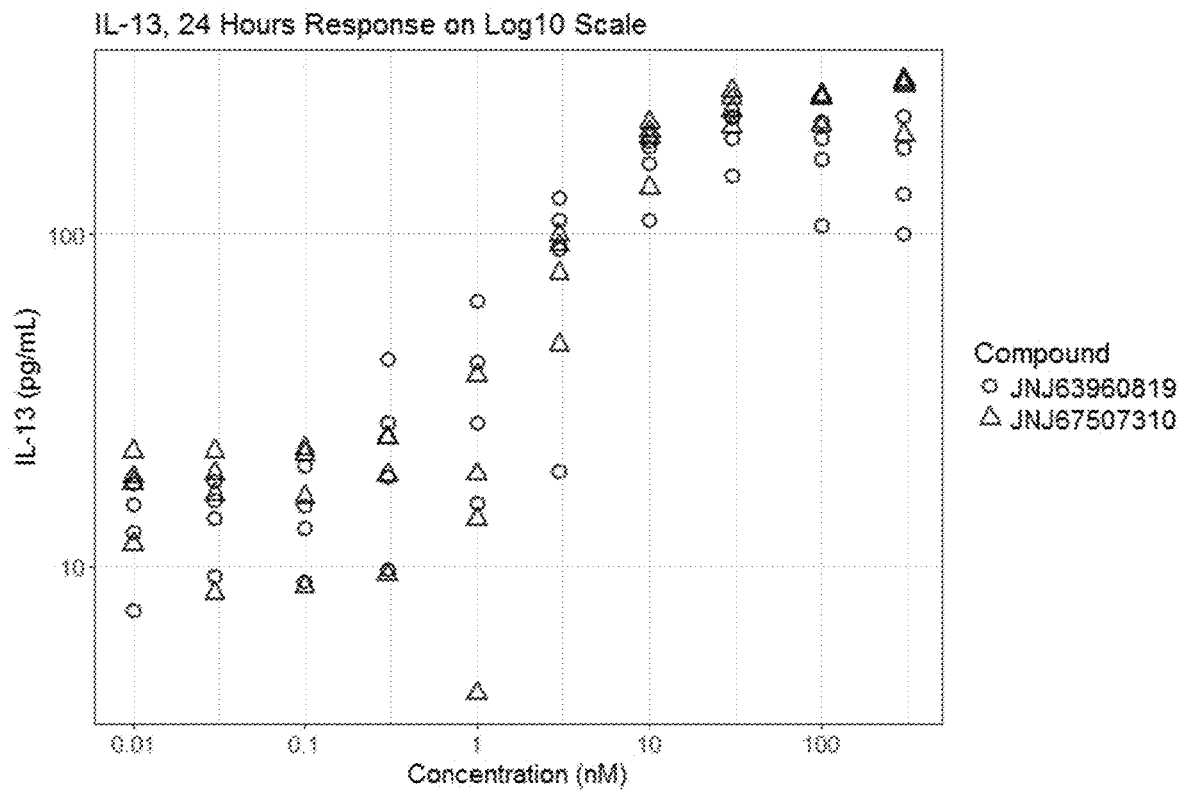

FIG. 50 shows T cell IL-13 release mediated by IC3B19 and IC3B34 after 24 hours.

Figure 51A:
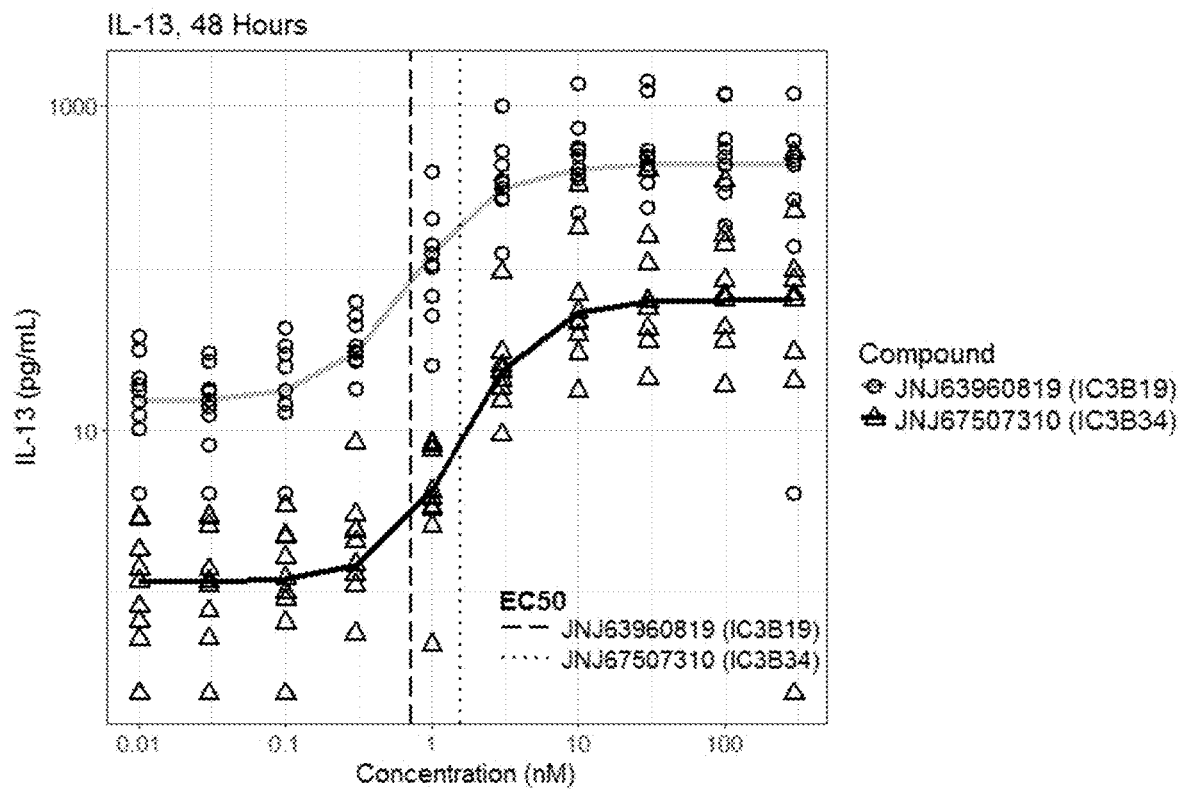
Figure 51B:
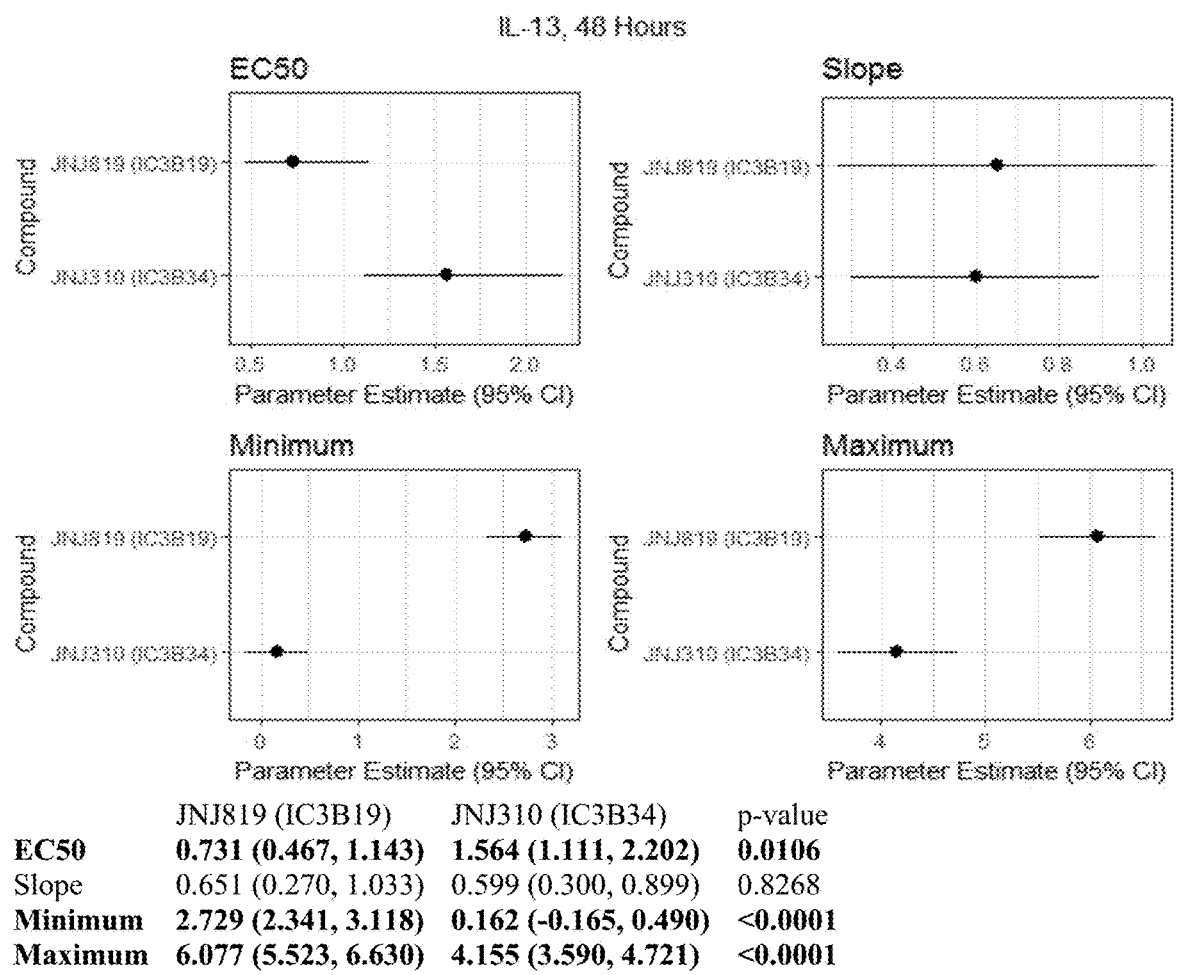

FIGS. 51A-51B show T cell IL-13 release mediated by IC3B19 and IC3B34 (FIG. 51A) and corresponding 4PL regression parameter estimates (FIG. 51B) after 48 hours.

Figure 52A:
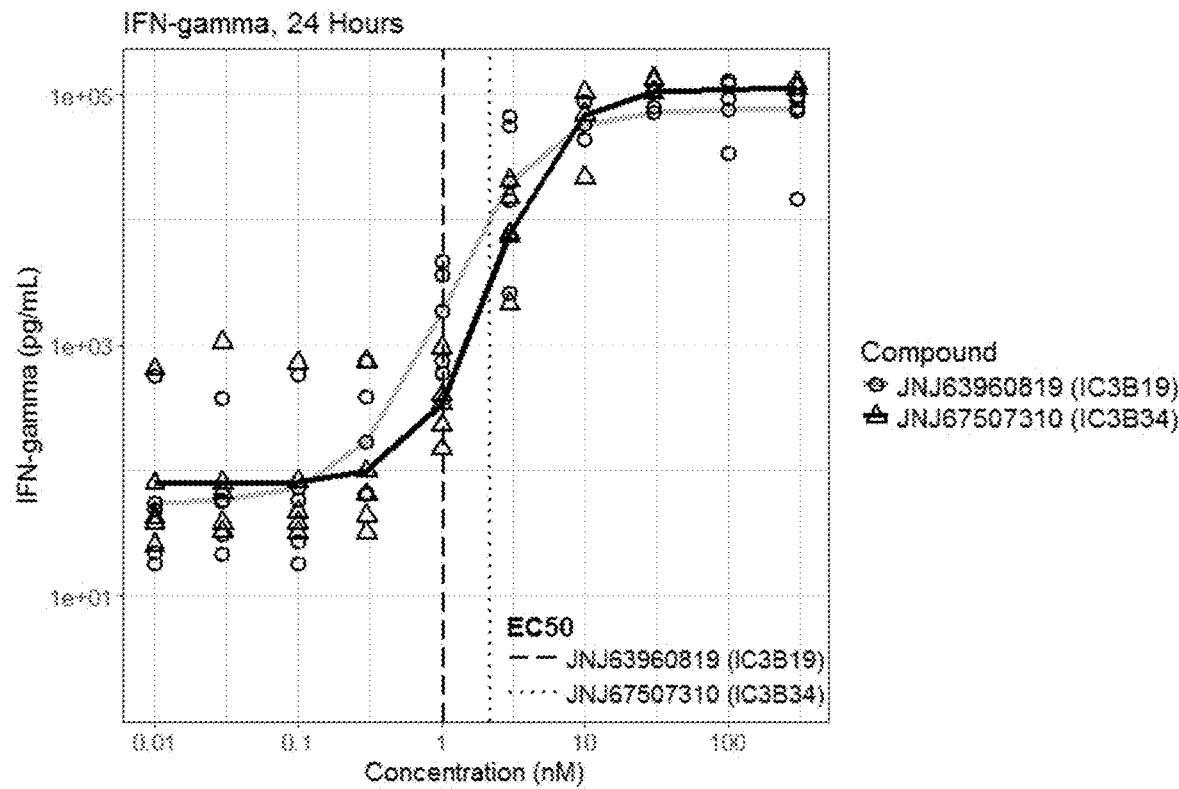
Figure 52B:
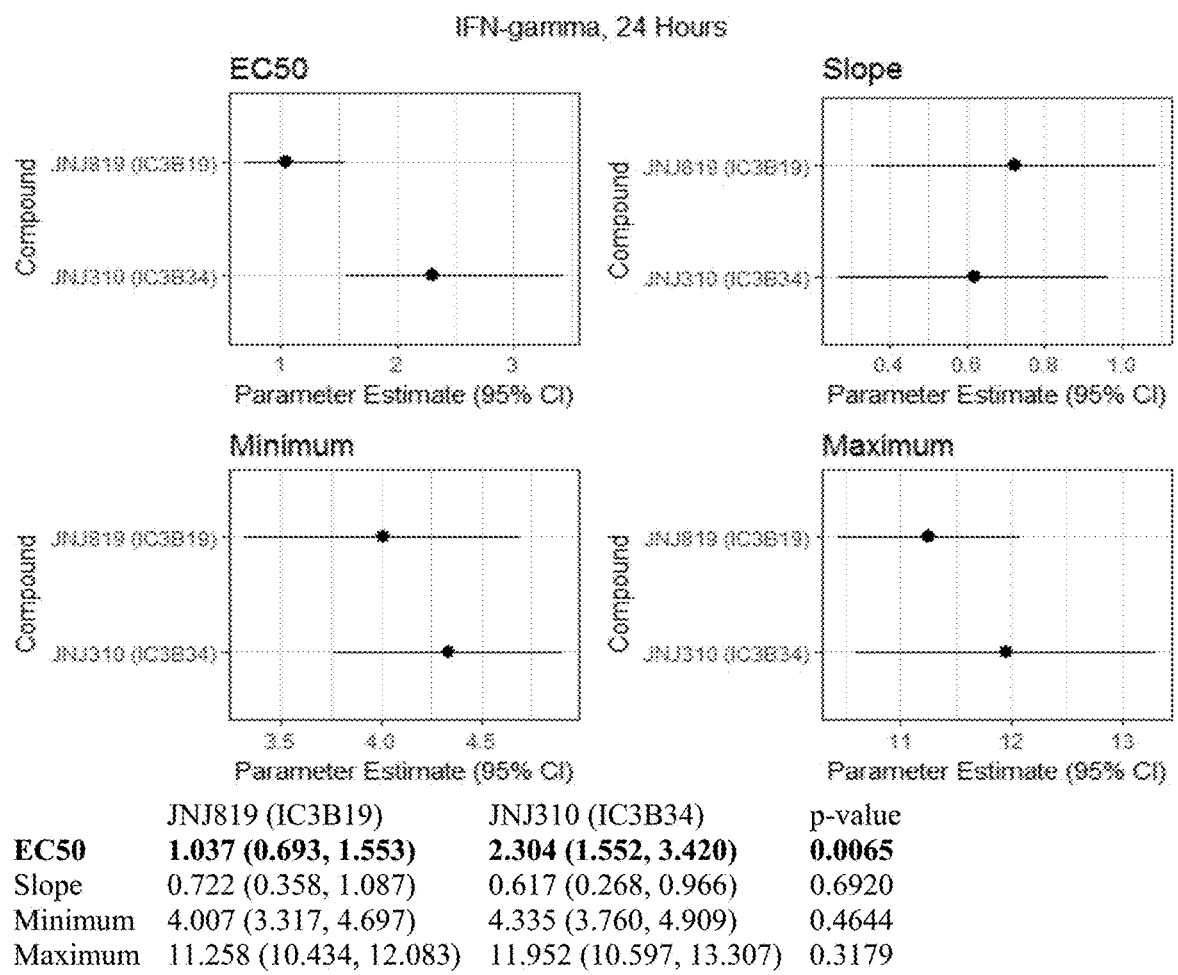

FIGS. 52A-52B show T cell IFN-gamma release mediated by IC3B19 and IC3B34 (FIG. 52A) and corresponding 4PL regression parameter estimates (FIG. 52B) after 24 hours.

Figure 53A:
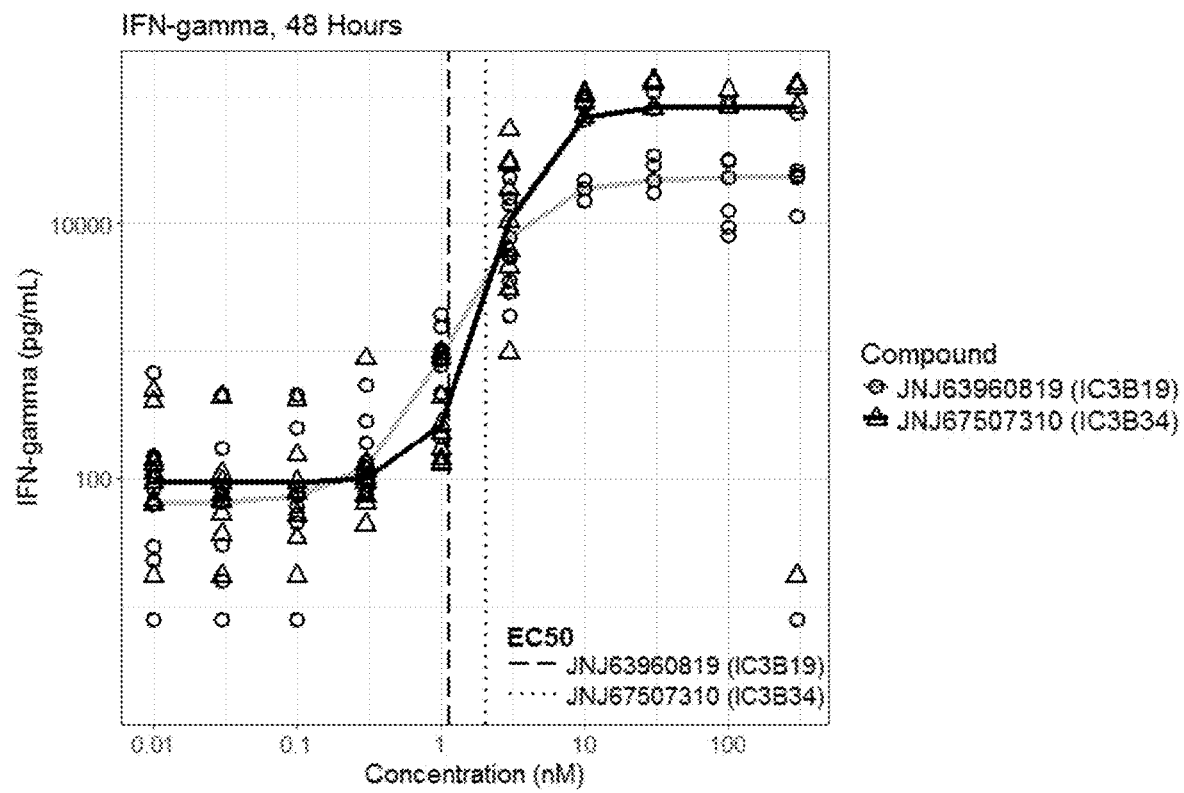
Figure 53B:
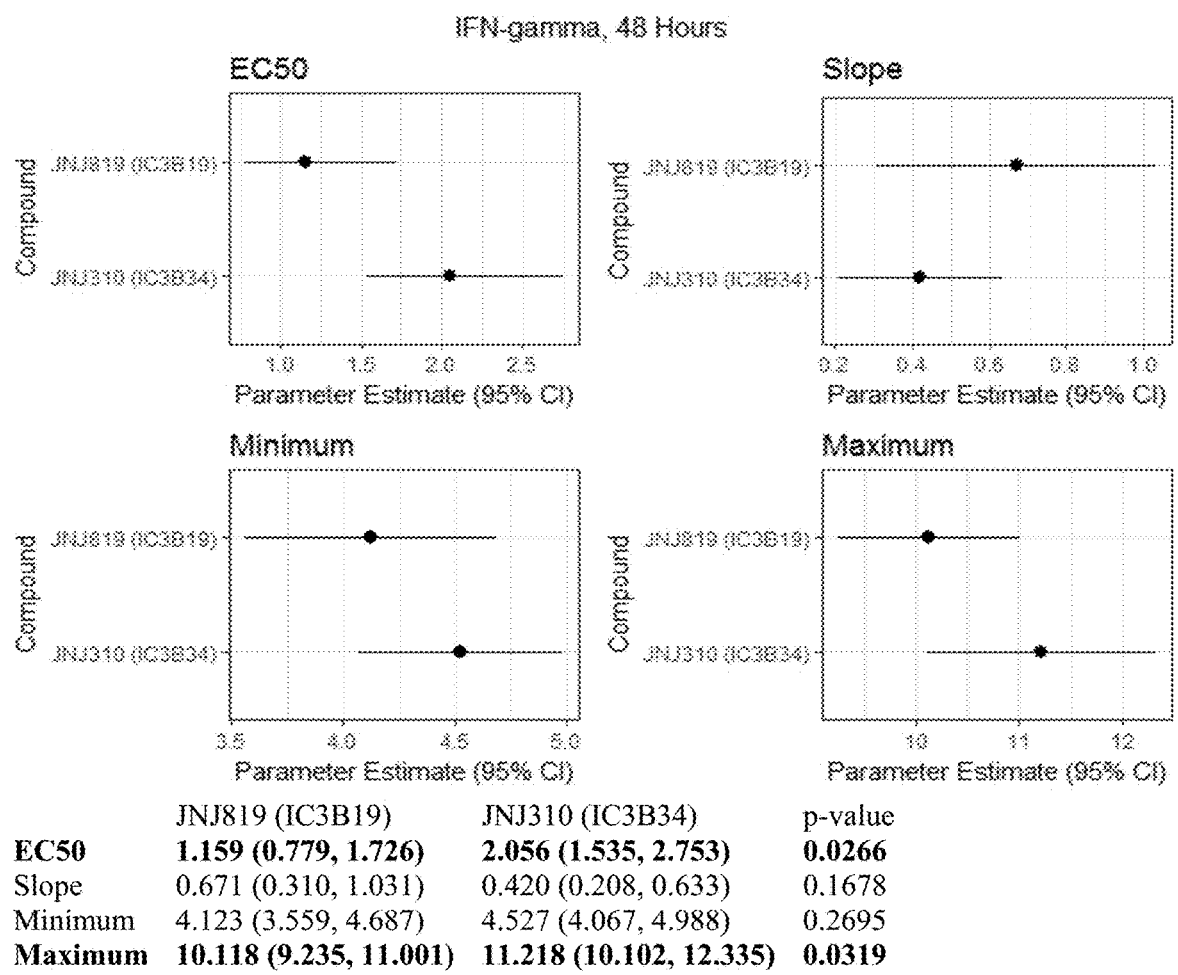

FIGS. 53A-53B show T cell IFN-gamma release mediated by IC3B19 and IC3B34 (FIG. 53A) and corresponding 4PL regression parameter estimates (FIG. 53B) after 48 hours.

Figure 54A:
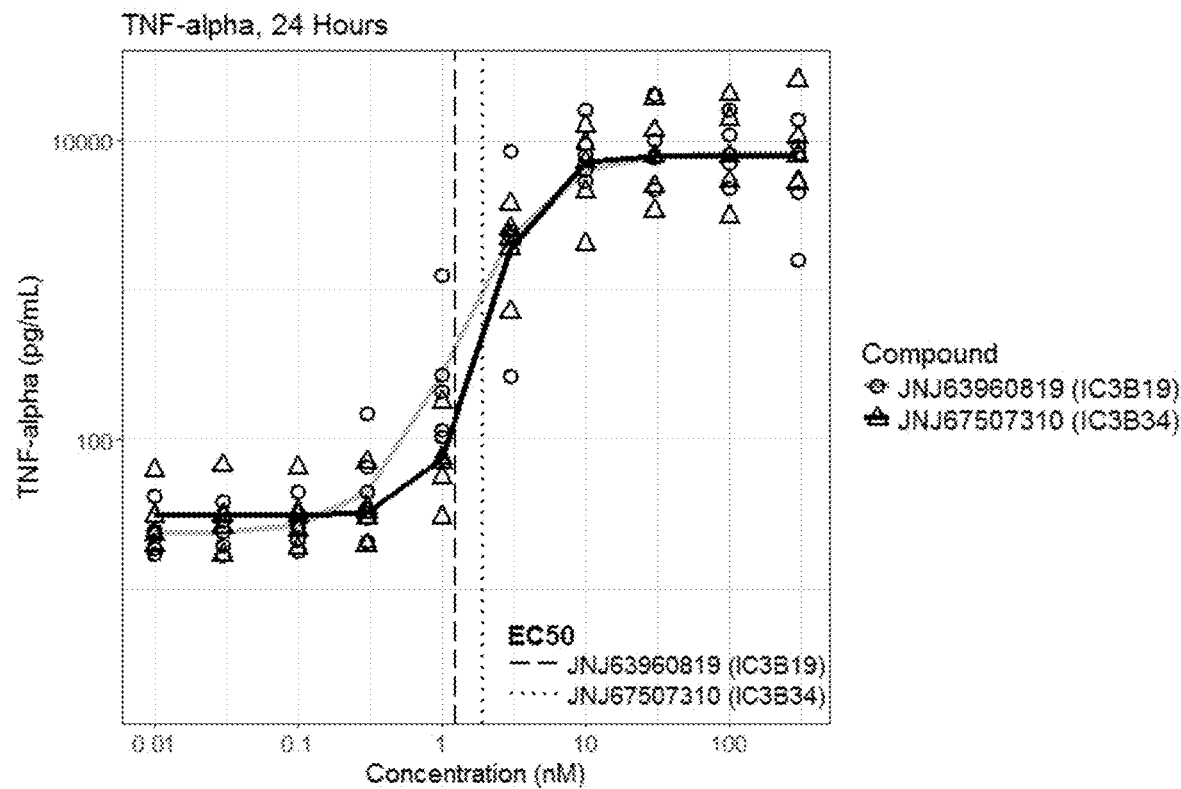
Figure 54B:
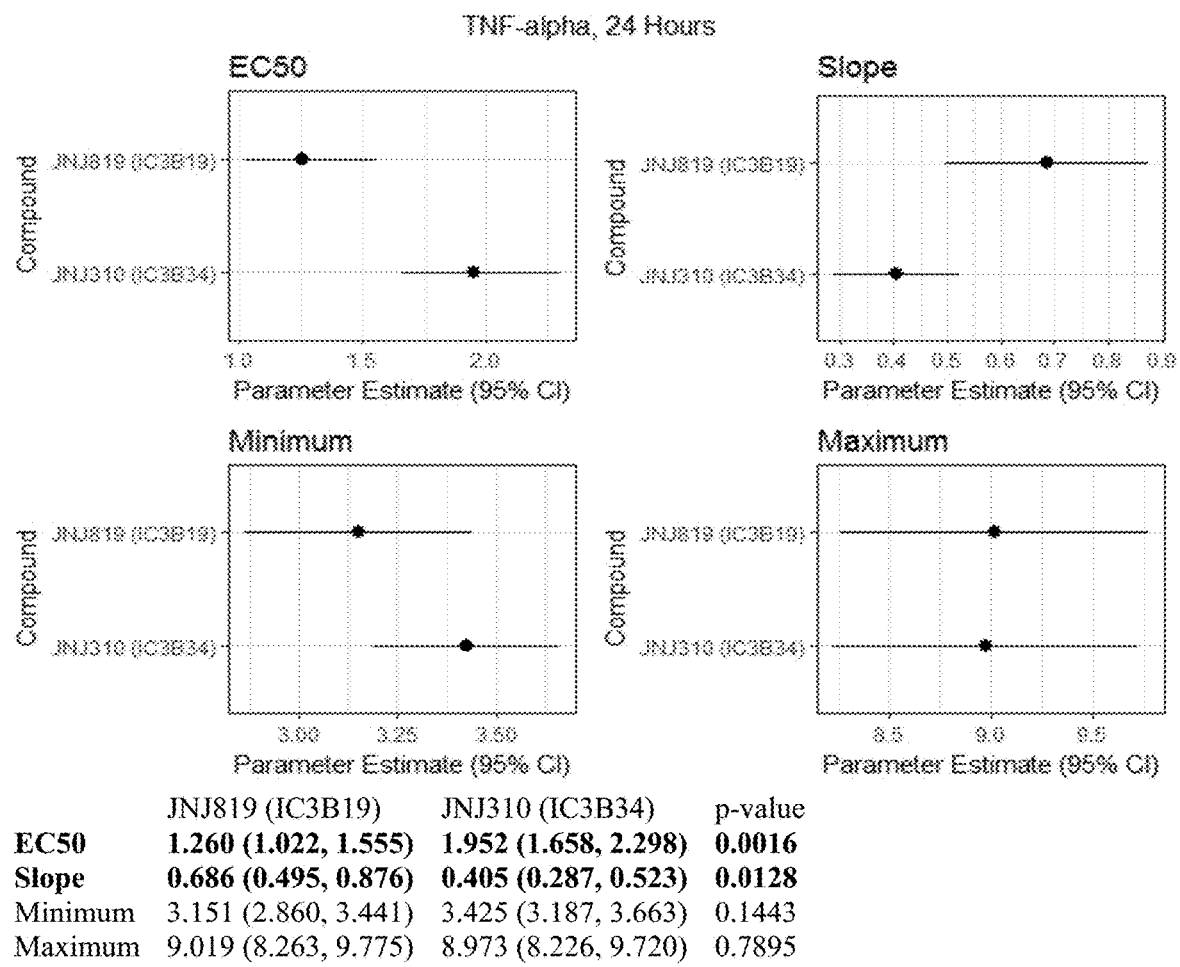

FIGS. 54A-54B show T cell TNF-alpha release mediated by IC3B19 and IC3B34 (FIG. 54A) and corresponding 4PL regression parameter estimates (FIG. 54B) after 24 hours.

Figure 55A:
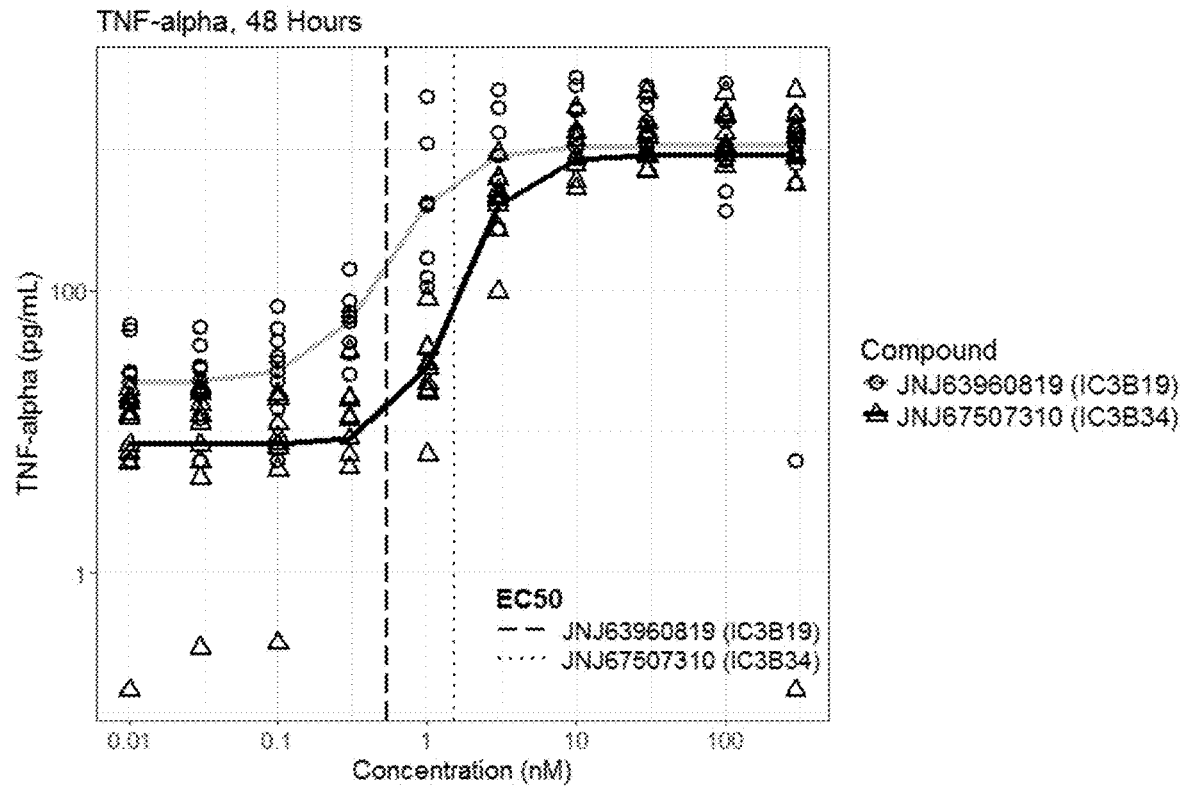
Figure 55B:
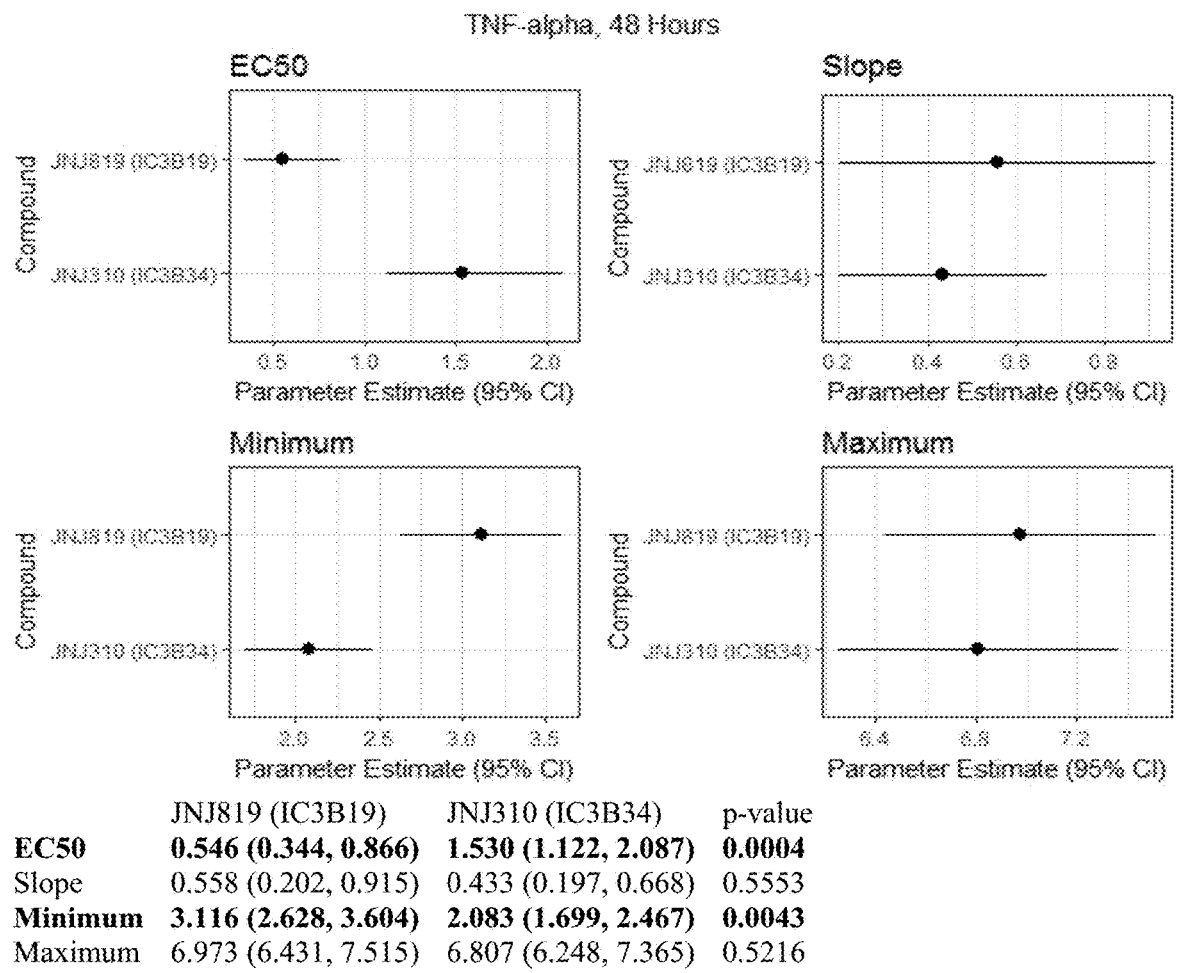

FIGS. 55A-55B show T cell TNF-alpha release mediated by IC3B19 and IC3B34 (FIG. 55A) and corresponding 4PL regression parameter estimates (FIG. 55B) after 48 hours.

Figure 56:
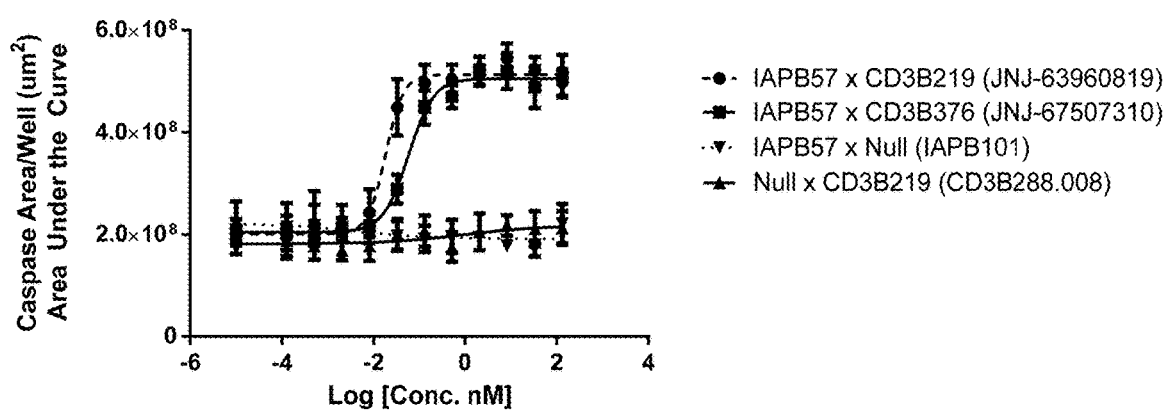

FIG. 56 shows IC3B19 and IC3B34, but not the bispecific antibodies with null arms (IAPB57×B23B49 or B23B39× CD3B219), induced target specific cytotoxicity in NCI-H1975 cells. In this assay, the cytotoxicity EC50s vary three-fold between IC3B19 and IC3B34, with values of 0.018 and 0.057 nM, respectively.

Figure 57:
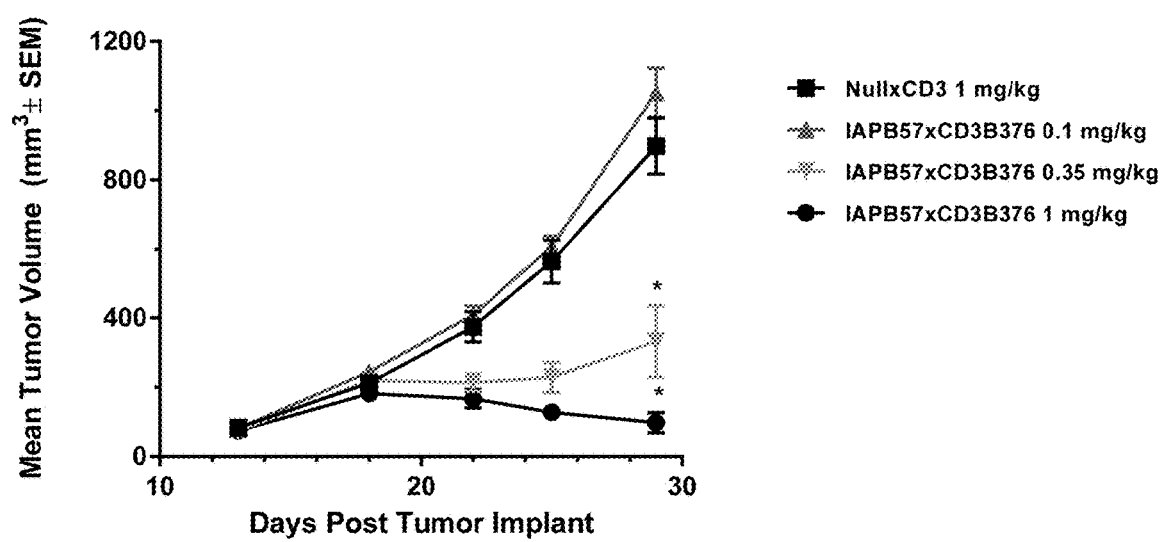

FIG. 57 shows Anti-Tumor Efficacy of IAPB57× CD3B376 in H1975 Human NSCLC Xenografts in T cell Humanized NSG Mice. Subcutaneous H1975 tumors were measured twice weekly and the results presented as the average tumor volume, expressed in mm3±SEM, *p<0.0001.

Figure 58:
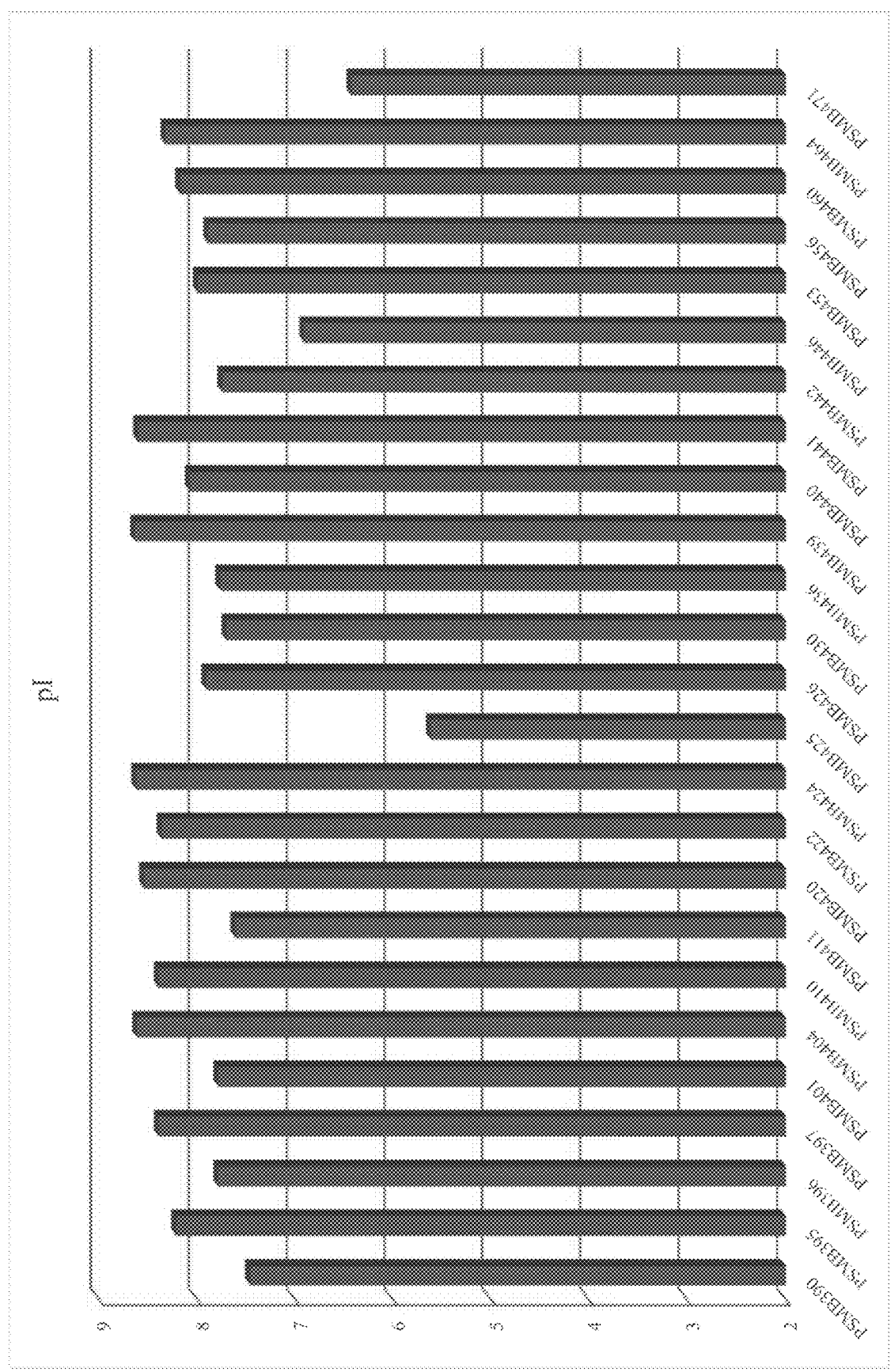

FIG. 58 shows a comparison of isoelectric points for various anti-PSMA constructs.

Figure 59:
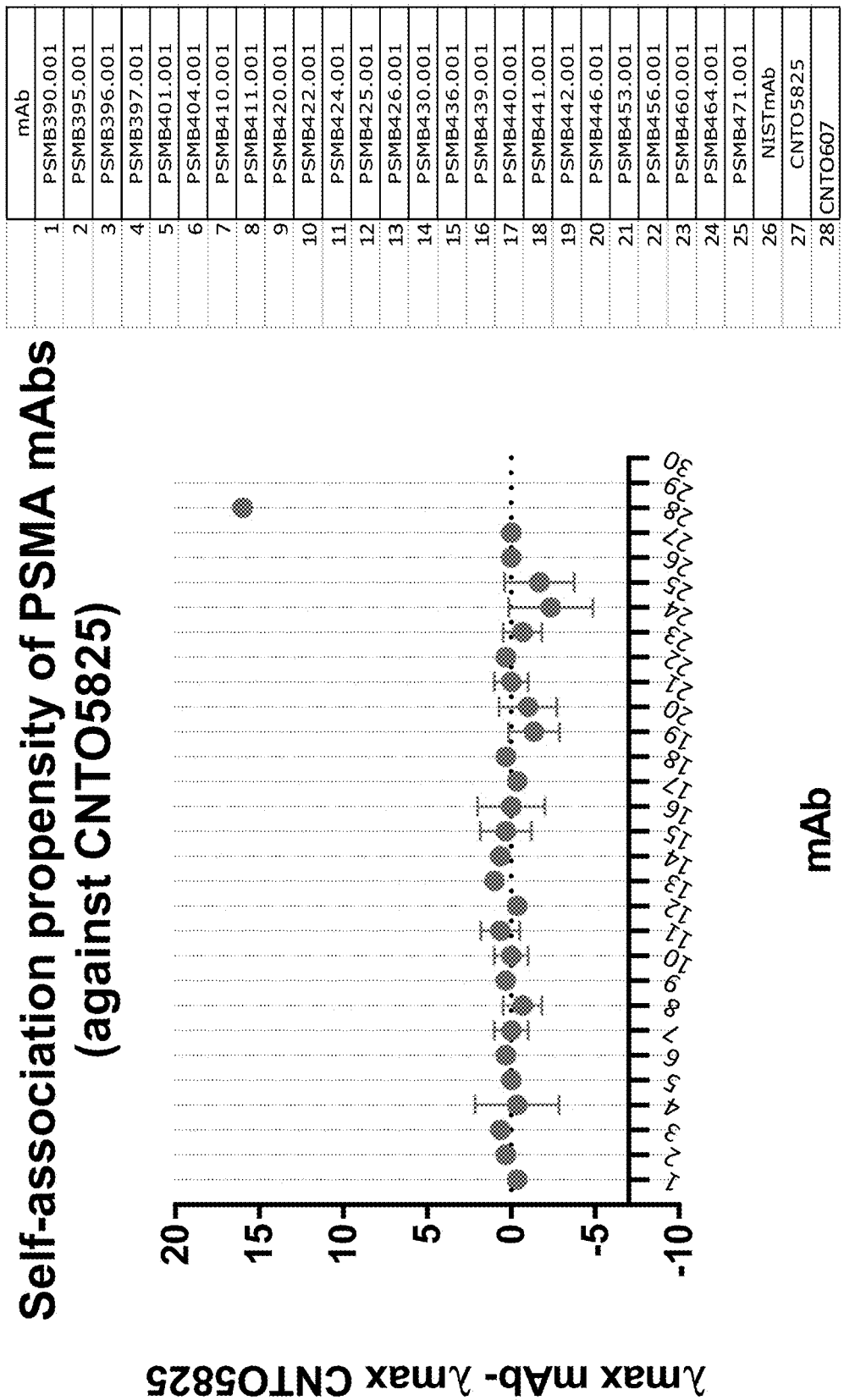

FIG. 59 plots change in wavelength compared to CNTO5825 control molecule. Control CNTO607 shows characteristically strong self-interaction. Error bars represent standard deviations from triplicate measurements.

Figure 60:
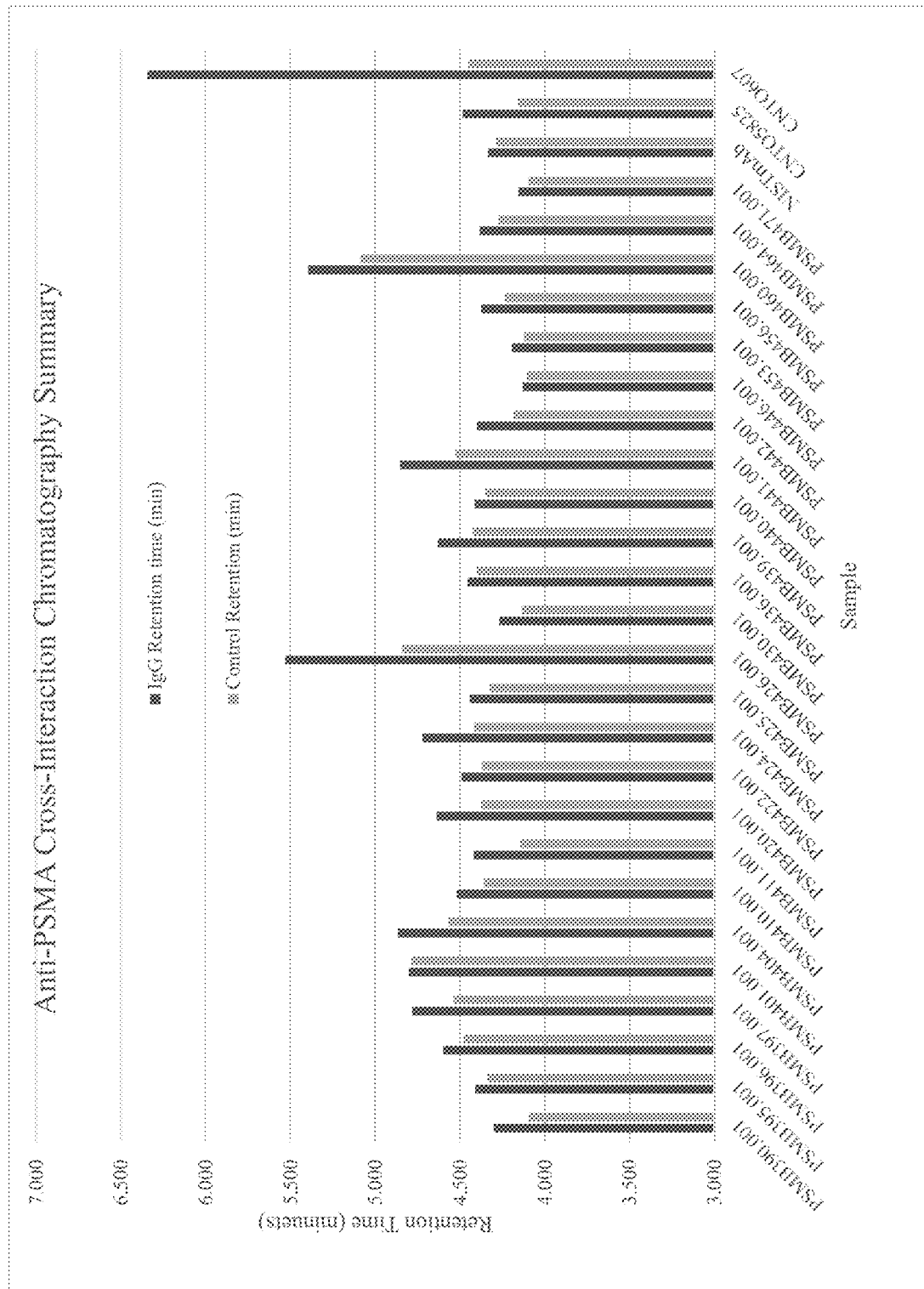

FIG. 60 shows a comparison of retention times on IgG and control columns in an anti-PSMA cross-interaction assay.

Figure 61A:
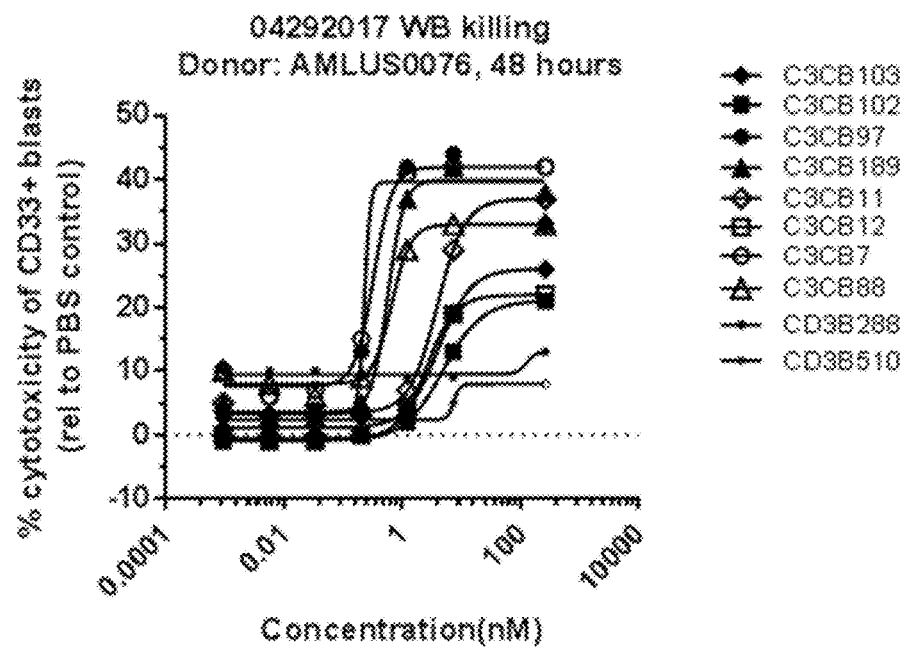
Figure 61B:
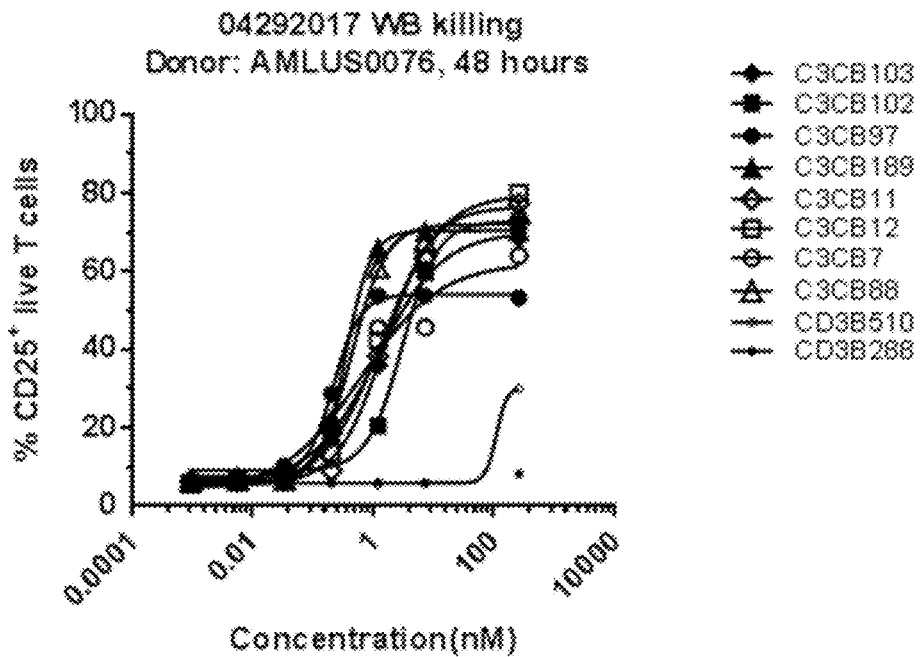

FIGS. 61A-61B show ex vivo assessment of CD33×CD3 bispecific antibodies using anti-CD3 arm CD3B219 and CD3B376 cytotoxicity of blasts and T cell activation in fresh AML patient whole blood. FIG. 61A shows the percent of total cell cytotoxicity of AML cells using CD33 bispecific antibodies or the CD3×null controls. FIG. 61B shows T cell activation induced by CD33 bispecific antibodies or the CD3×null controls. No Fc blocker was added.

Figure 62A:
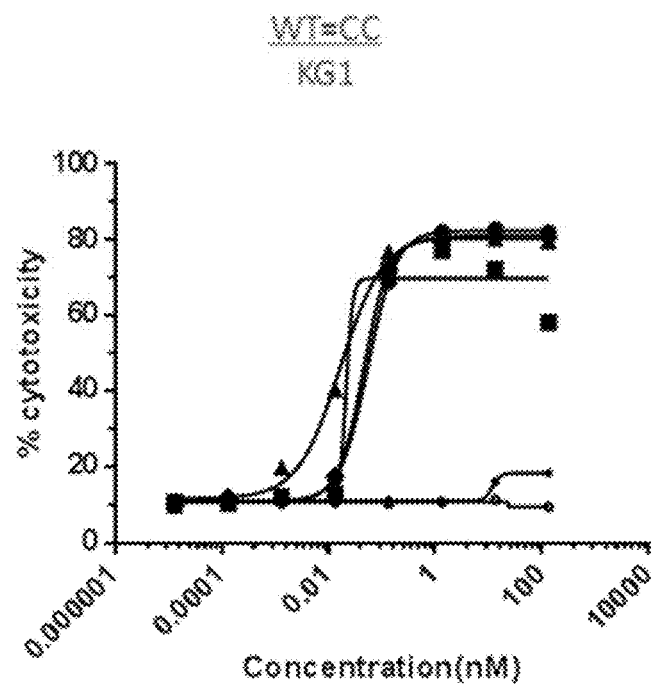
Figure 62B:
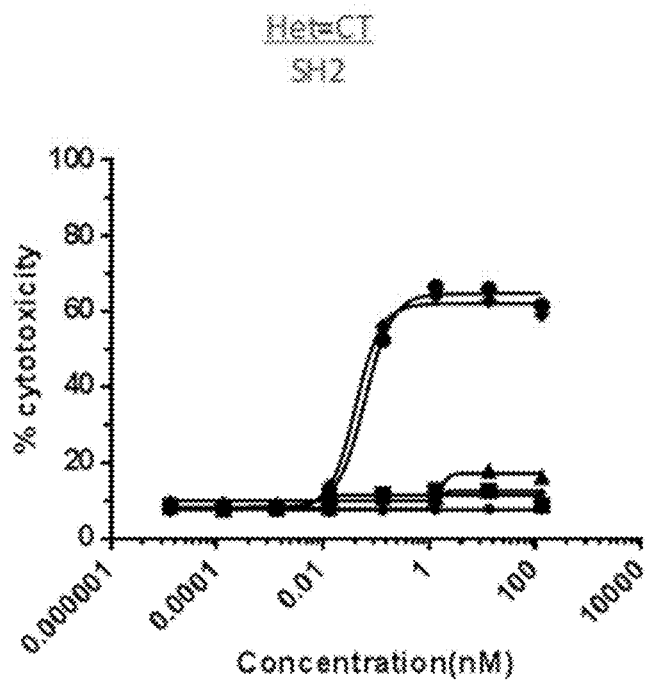
Figure 62C:
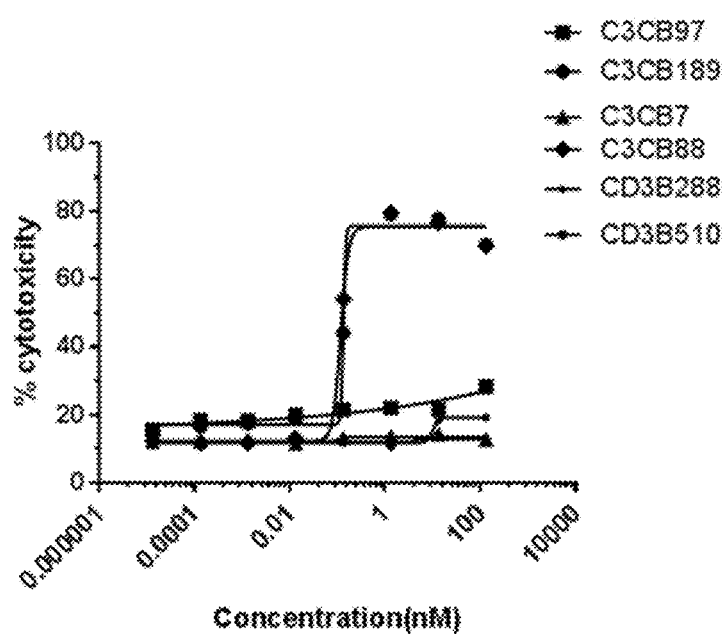

FIGS. 62A-62C show CD33×CD3 T-cell mediated cytotoxicity assays. CD33×CD3 bispecific antibodies using anti-CD3 arm CD3B219 and anti-CD3B376 were incubated with human pan T cells and AML cell lines that are either wildtype (KG1, FIG. 62A), heterozygous (SH2, FIG. 62B) or homozygous (OCIAML3, FIG. 62C) for the CD33 SNP rs12459419 mutation. After 48 hr at 37° C., 5% $CO_2$, total tumor cell cytotoxicity was measured by flow cytometry.

Figure 63A:
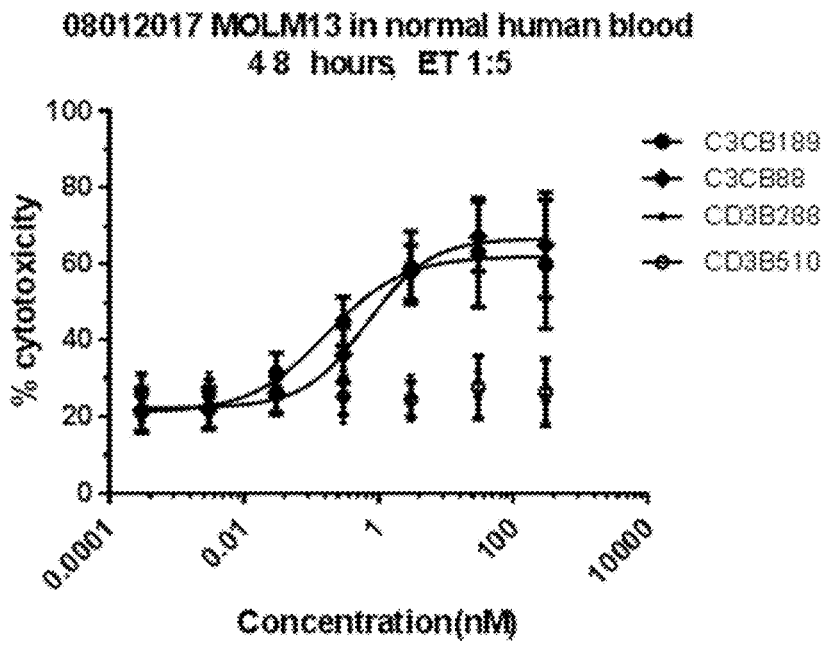
Figure 63B:
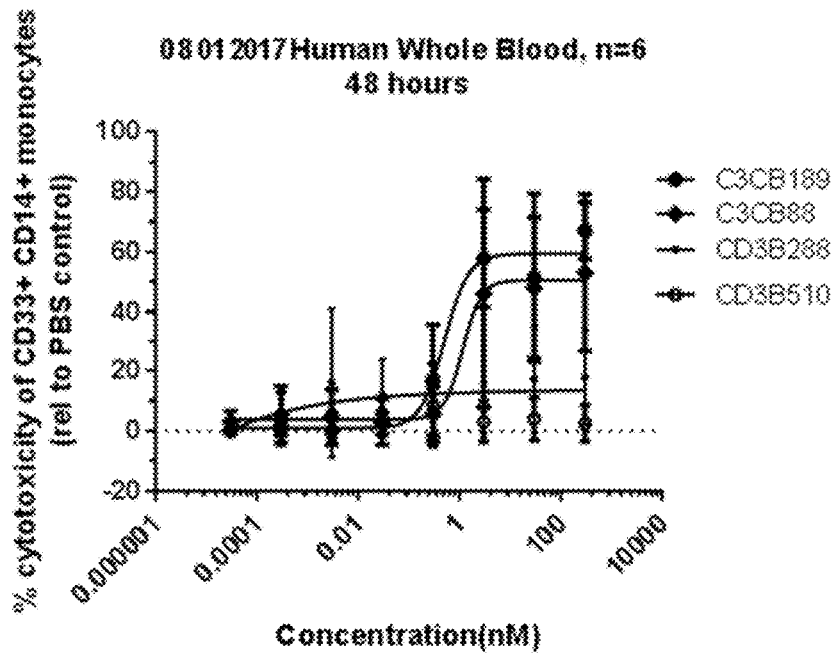

FIGS. 63A-63B show ex vivo assessment of C33B904 antibodies paired with either CD3B219 or CD3B376 on the cytotoxicity of MOLM-13 cells exogenously added to normal healthy human whole blood (N=6 donors): Percent of cytotoxicity of MOLM-13 cells (FIG. 63A) and $CD33^+$ $CD14^+$ monocytes (FIG. 63B) using CD33×CD3 bispecifics and respective null×CD3 controls at 48 hrs.

Figure 64A:
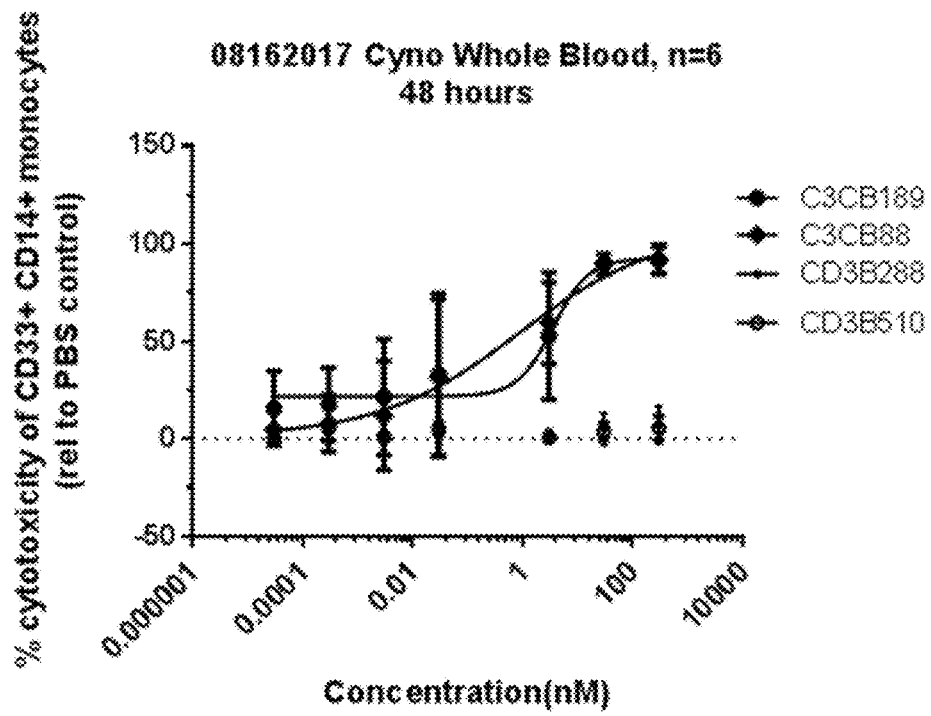
Figure 64B:
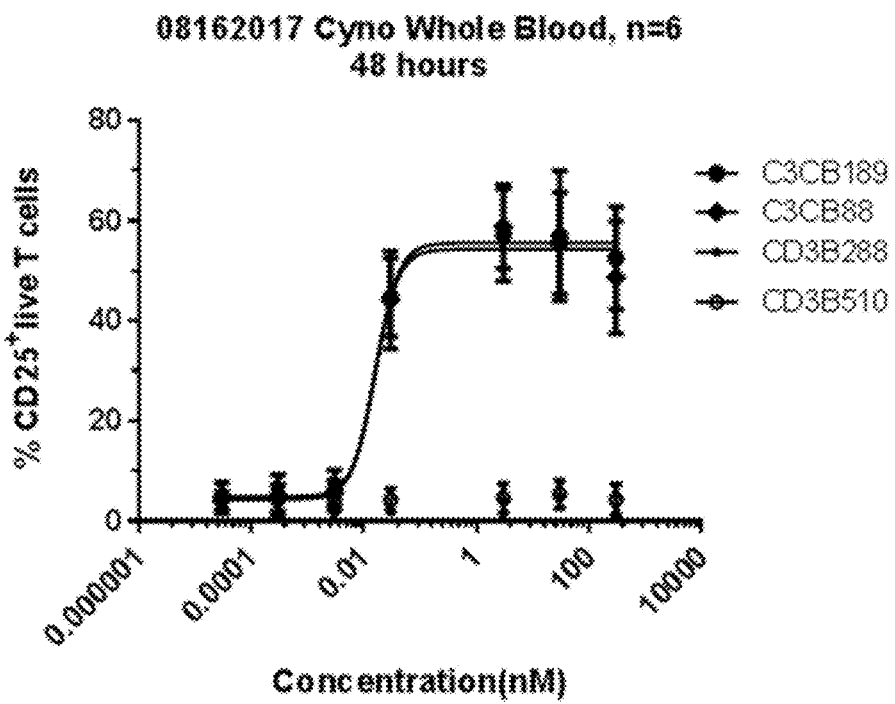

FIGS. 64A-64B show ex vivo assessment of CD33×CD3 bispecific antibodies using anti-CD3 arm CD3B219 and CD3B376 on the cytotoxicity of monocytes and T cell activation in fresh whole blood from six normal cynomolgous monkey donors. FIG. 64A shows the percent of total cell cytotoxicity of $CD33^+CD14^+$ cyno monocytes using CD33 bispecific antibodies or their CD3×null controls. FIG. 64B shows T cell activation induced by CD33 bispecific antibodies or their CD3×null controls. No Fc blocker was added.

Figure 65:
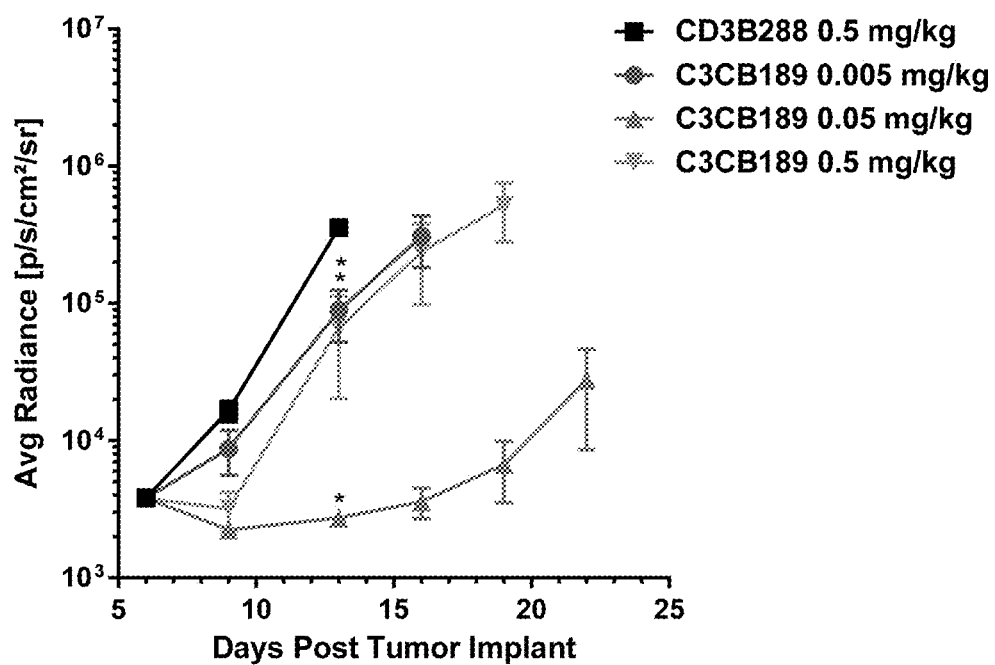

FIG. 65 shows anti-tumor efficacy of C3CB189 in MOLM-13 human AML xenografts in T cell humanized NSG mice. Disseminated MOLM-13 tumors were imaged for bioluminescence (BLI) twice weekly and the results presented as average radiance (p/s/cm²/sr)±SEM (n=8-10/group). *p≤0.0001 for treatment vs. control, calculated by two-way ANOVA with Bonferroni test.

Figure 66:
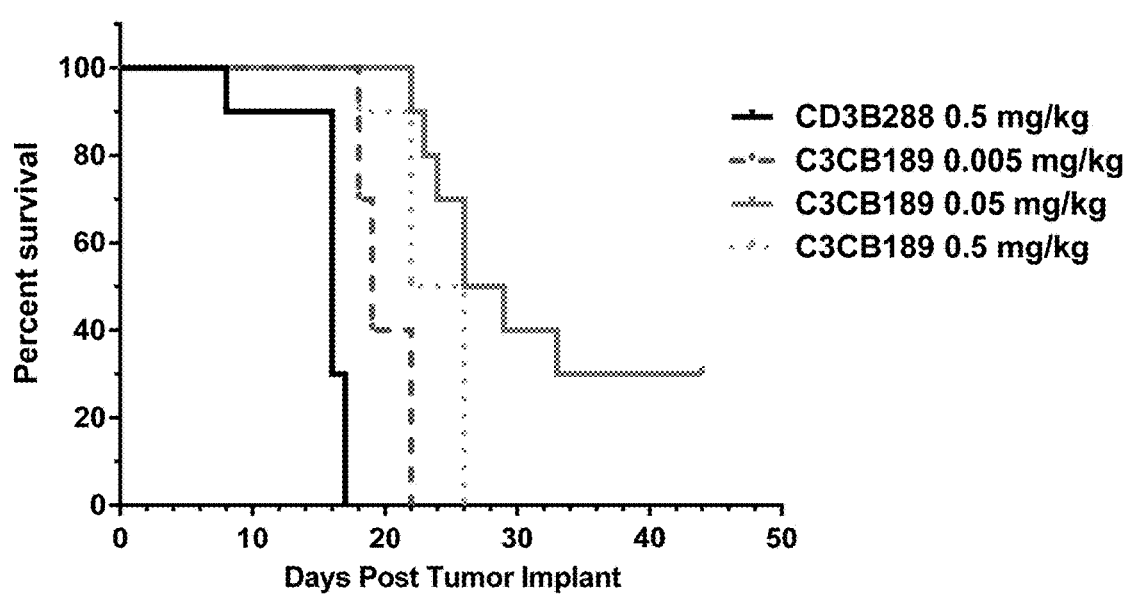

FIG. 66 shows survival of animals treated with C3CB189 in MOLM-13 Human AML xenografts in T cell humanized NSG mice. Survival of MOLM-13 bearing mice is graphically represented using a Kaplan-Meier curve and evaluated by Log-rank (Mantel-Cox) test. *p<0.0001 for treatment vs. control groups.

Figure 67:
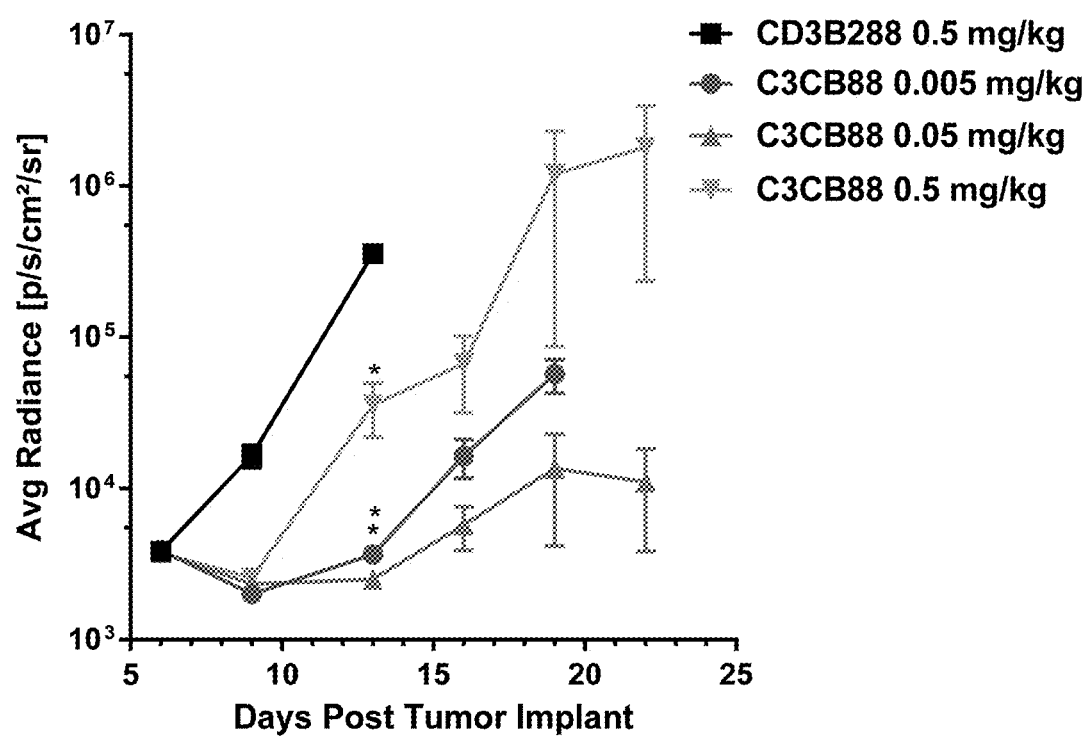

FIG. 67 shows anti-tumor efficacy of C3CB88 in MOLM-13 human AML xenografts in T cell humanized NSG mice. Disseminated MOLM-13 tumors were imaged for bioluminescence (BLI) twice weekly and the results presented as average radiance (p/s/cm²/sr)±SEM (n=8-10/group). *p≤0.0001 for treatment vs. control, calculated by two-way ANOVA with Bonferroni test.

Figure 68:
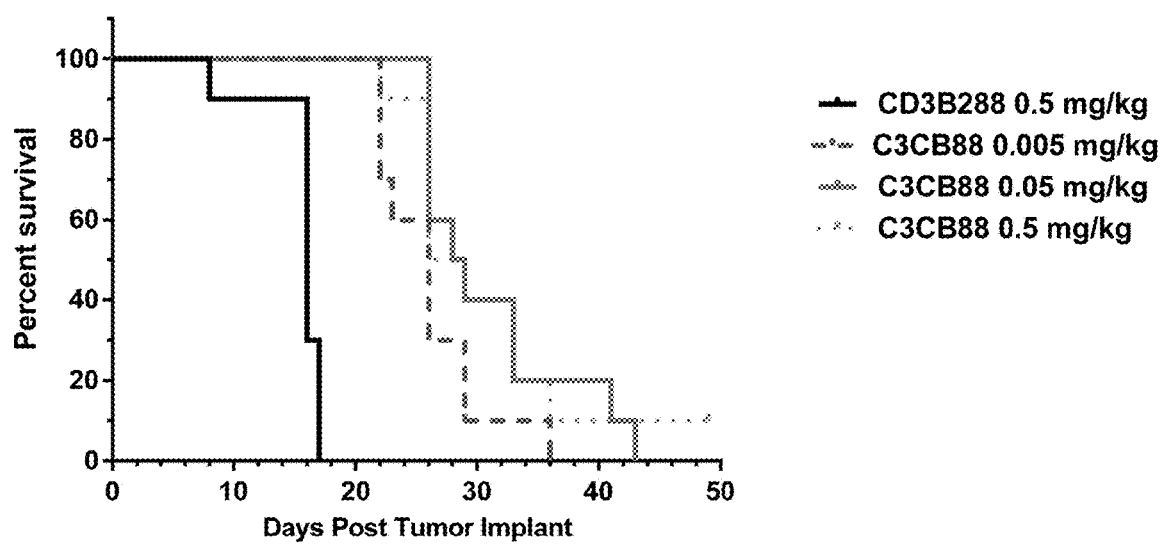

FIG. 68 shows survival of animals treated with C3CB88 in MOLM-13 human AML xenografts in T cell humanized NSG mice. Survival of MOLM-13 bearing mice is graphically represented using a Kaplan-Meier curve and evaluated by Log-rank (Mantel-Cox) test. *p<0.05 for treatment vs. control groups.

FIG. 69 shows the alignment of select anti-TMEFF2 antibody heavy chain variable regions (VH). The VH regions are identified by their SEQ ID NO: at the beginning of each row.

FIG. 70 shows the alignment of select anti-TMEFF2 antibody light chain variable regions (VL). The VH regions are identified by their SEQ ID NO: at the beginning of each row.

Figure 71:
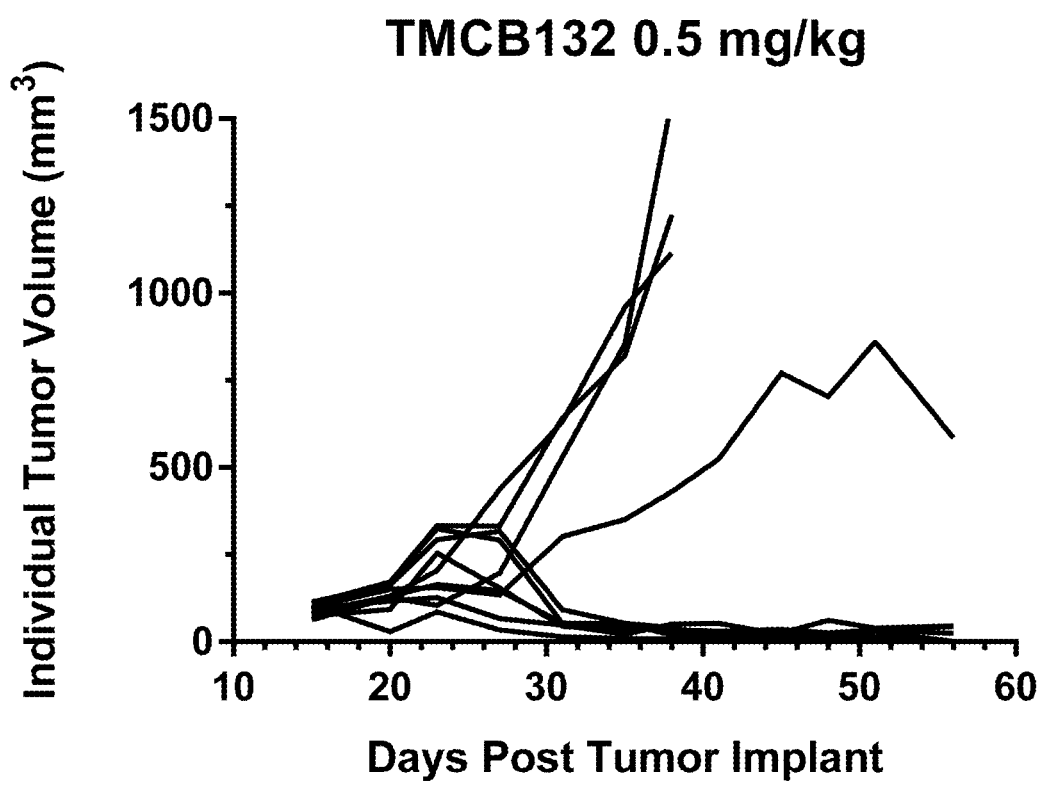

FIG. 71 shows the reduction in mean tumor volume of each mouse treated with 0.5 mg/kg TMCB132 in an ex vivo LnCaP prostate cancer model in male NGS mice.

Figure 72:
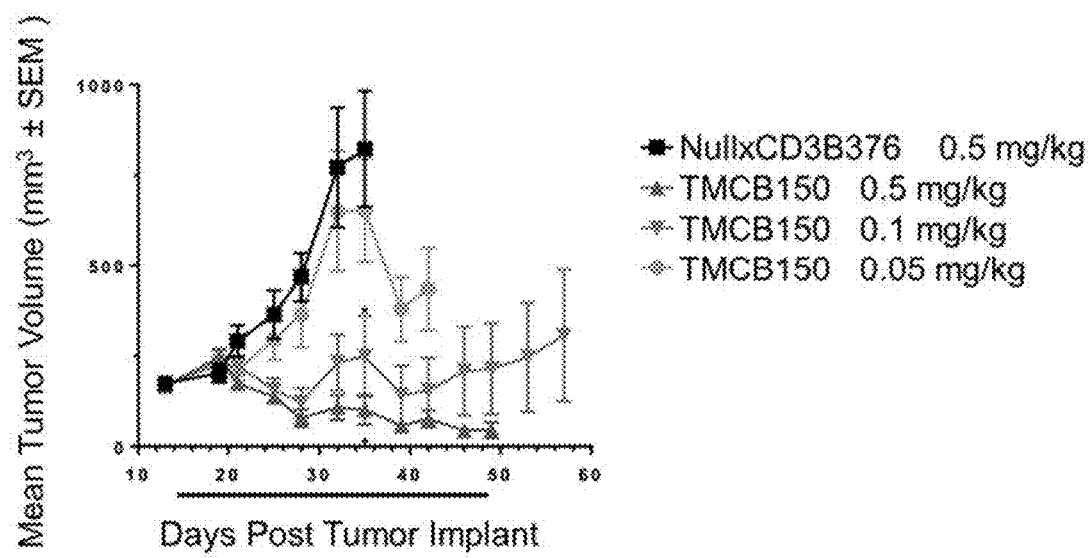

FIG. 72 shows efficacy of TMEB762×CD3B376 in established LNCaP Xenografts in T Cell Humanized NSG Mice.

Figure 73:
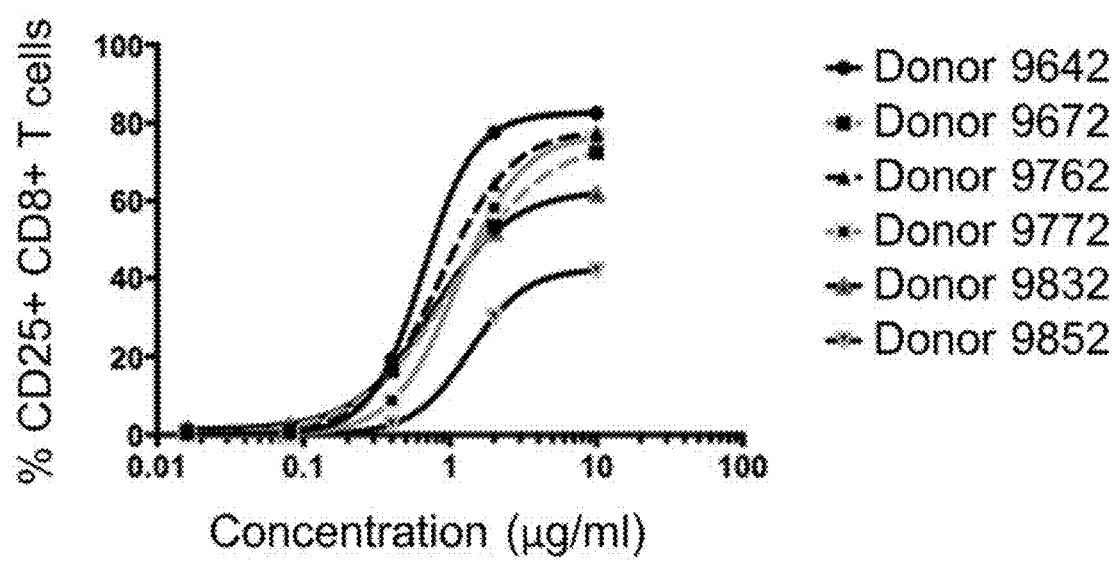

FIG. 73 shows T-cell activation in LnCaP prostatec cancer cells in response to administration of TMCB132.

Figure 74:
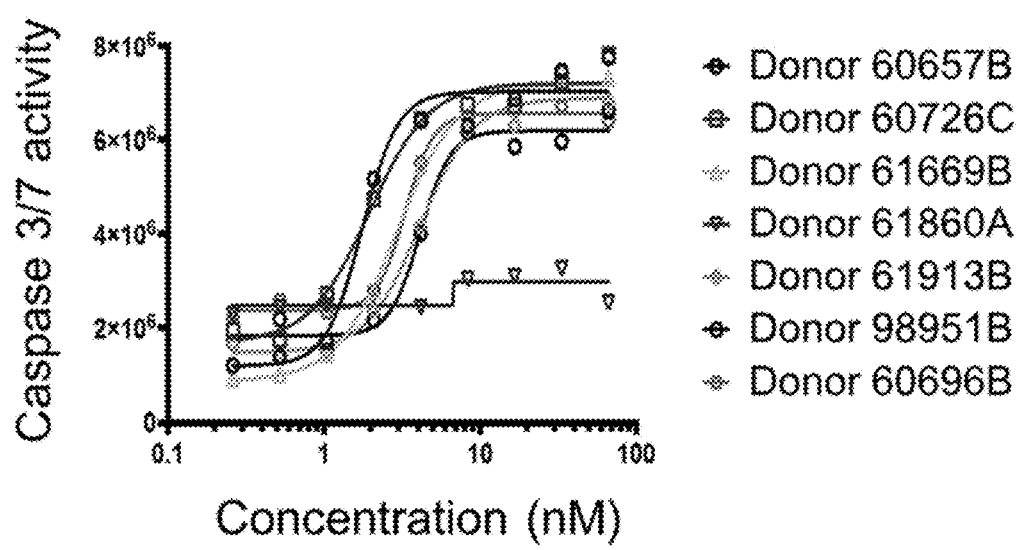

FIG. 74 shows T cell-mediated cytotoxicity of TMCB132.

Figure 75:
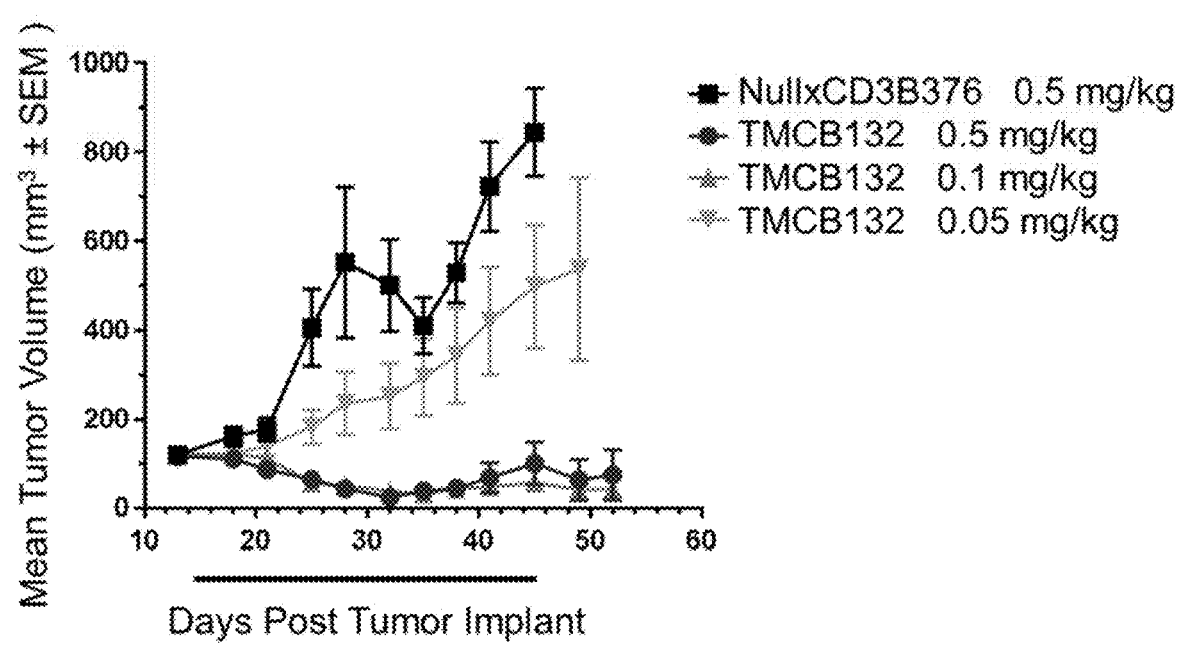

FIG. 75 shows the antitumor efficacity of TMCB132 in T-cell humanized mice.

DETAILED DESCRIPTION OF THE INVENTION

All publications, including but not limited to patents and patent applications, cited in this specification are herein incorporated by reference as though fully set forth.

It is to be understood that the terminology used herein is for the purpose of describing particular embodiments only and is not intended to be limiting. Unless defined otherwise, all technical and scientific terms used herein have the same meaning as commonly understood by one of ordinary skill in the art to which the invention pertains.

Although any methods and materials similar or equivalent to those described herein may be used in the practice for testing of the present invention, exemplary materials and methods are described herein. In describing and claiming the present invention, the following terminology will be used.

As used in this specification and the appended claims, the singular forms "a," "an," and "the" include plural referents unless the content clearly dictates otherwise. Thus, for example, reference to "a cell" includes a combination of two or more cells, and the like.

"Specific binding" or "specifically binds" or "binds" refers to an antibody binding to an antigen or an epitope within the antigen with greater affinity than for other antigens. Typically, the antibody binds to the antigen or the epitope within the antigen with an equilibrium dissociation constant ($K_D$) of about $5\times10^{-8}$ M or less, for example about $1\times10^{-9}$ M or less, about $1\times10^{-10}$ M or less, about $1\times10^{-11}$ M or less, or about $1\times10^{-12}$ M or less, typically with the $K_D$ that is at least one hundred-fold less than its $K_D$ for binding to a non-specific antigen (e.g., BSA, casein). The dissociation constant may be measured using standard procedures. Antibodies that specifically bind to the antigen or the epitope within the antigen may, however, have cross-reactivity to other related antigens, for example to the same antigen from other species (homologs), such as human or monkey, for example *Macaca fascicularis* (cynomolgus, cyno) or *Pan troglodytes* (chimpanzee, chimp). While a monospecific antibody specifically binds one antigen or one epitope, a bispecific antibody specifically binds two distinct antigens or two distinct epitopes.

"Antibodies" is meant in a broad sense and includes immunoglobulin molecules including monoclonal antibodies including murine, human, humanized and chimeric monoclonal antibodies, antigen binding fragments, bispecific or multispecific antibodies, dimeric, tetrameric or multimeric antibodies, single chain antibodies, domain antibodies and any other modified configuration of the immunoglobulin molecule that comprises an antigen binding site of the required specificity. "Full length antibody molecules" are comprised of two heavy chains (HC) and two light chains (LC) inter-connected by disulfide bonds as well as multimers thereof (e.g. IgM). Each heavy chain is comprised of a heavy chain variable region (VH) and a heavy chain constant region (comprised of domains CH1, hinge, CH2 and CH3). Each light chain is comprised of a light chain variable region (VL) and a light chain constant region (CL). The VH and the VL regions may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4.

"Complementarity determining regions (CDR)" are antibody regions that bind an antigen. CDRs may be defined using various delineations such as Kabat (Wu et al. (1970) J Exp Med 132: 211-50) (Kabat et al., Sequences of Proteins of Immunological Interest, 5th Ed. Public Health Service, National Institutes of Health, Bethesda, Md., 1991), Chothia (Chothia et al. (1987) J Mol Biol 196: 901-17), IMGT (Lefranc et al. (2003) Dev Comp Immunol 27: 55-77) and AbM (Martin and Thornton (1996) J Bmol Biol 263: 800-15). The correspondence between the various delineations and variable region numbering are described (see e.g. Lefranc et al. (2003) Dev Comp Immunol 27: 55-77; Honegger and Pluckthun, (2001) J Mol Biol 309:657-70; International ImMunoGeneTics (IMGT) database; Web resources, http://www_imgt_org). Available programs such as abYsis by UCL Business PLC may be used to delineate CDRs. The term "CDR", "HCDR1", "HCDR2", "HCDR3", "LCDR1", "LCDR2" and "LCDR3" as used herein includes CDRs defined by any of the methods described supra, Kabat, Chothia, IMGT or AbM, unless otherwise explicitly stated in the specification.

Immunoglobulins may be assigned to five major classes, IgA, IgD, IgE, IgG and IgM, depending on the heavy chain constant domain amino acid sequence. IgA and IgG are further sub-classified as the isotypes IgA1, IgA2, IgG1, IgG2, IgG3 and IgG4. Antibody light chains of any vertebrate species may be assigned to one of two clearly distinct types, namely kappa (κ) and lambda (λ), based on the amino acid sequences of their constant domains.

"Antigen binding fragment" refers to a portion of an immunoglobulin molecule that binds an antigen. Antigen binding fragments may be synthetic, enzymatically obtainable or genetically engineered polypeptides and include the VH, the VL, the VH and the VL, Fab, F(ab')2, Fd and Fv fragments, domain antibodies (dAb) consisting of one VH domain or one VL domain, shark variable IgNAR domains, camelized VH domains, minimal recognition units consisting of the amino acid residues that mimic the CDRs of an antibody, such as FR3-CDR3-FR4 portions, the HCDR1, the HCDR2 and/or the HCDR3 and the LCDR1, the LCDR2 and/or the LCDR3. VH and VL domains may be linked together via a synthetic linker to form various types of single chain antibody designs where the VH/VL domains may pair intramolecularly, or intermolecularly in those cases when the VH and VL domains are expressed by separate single chain antibody constructs, to form a monovalent antigen binding site, such as single chain Fv (scFv) or diabody; described for example in Int. Patent Publ. Nos. WO1998/44001, WO1988/01649, WO1994/13804 and WO1992/01047.

"Monoclonal antibody" refers to an antibody obtained from a substantially homogenous population of antibody molecules, i.e., the individual antibodies comprising the population are identical except for possible well-known alterations such as removal of C-terminal lysine from the antibody heavy chain or post-translational modifications such as amino acid isomerization or deamidation, methionine oxidation or asparagine or glutamine deamidation. Monoclonal antibodies typically bind one antigenic epitope. A bispecific monoclonal antibody binds two distinct antigenic epitopes. Monoclonal antibodies may have heterogeneous glycosylation within the antibody population. Monoclonal antibody may be monospecific or multispecific such as bispecific, monovalent, bivalent or multivalent.

"Isolated antibody" refers to an antibody or antibody fragment that is substantially free of other antibodies having different antigenic specificities (e.g., an isolated antibody specifically binding an antigen is substantially free of antibodies that specifically bind antigens other than the antigen). In the case of bispecific CD3 antibodies, the bispecific antibody specifically binds both CD3 a second antigen. "Isolated antibody" encompasses antibodies that are isolated to a higher purity, such as antibodies that are 80%, 81%, 82%, 83%, 84%, 85%, 86%, 87%, 88%, 89%, 90%, 91%, 92%, 93%, 94%, 95%, 96%, 97%, 98%, 99% or 100% pure.

"Humanized antibody" refers to an antibody in which at least one CDR is derived from non-human species and at least one framework is derived from human immunoglobulin sequences. Humanized antibody may include substitutions in the frameworks so that the frameworks may not be exact copies of expressed human immunoglobulin or human immunoglobulin germline gene sequences.

"Human antibody" refers to an antibody that is optimized to have minimal immune response when administered to a human subject. Variable regions of human antibody are derived from human immunoglobulin sequences. If human antibody contains a constant region or a portion of the constant region, the constant region is also derived from human immunoglobulin sequences. Human antibody comprises heavy and light chain variable regions that are "derived from" sequences of human origin if the variable regions of the human antibody are obtained from a system that uses human germline immunoglobulin or rearranged immunoglobulin genes. Such exemplary systems are human immunoglobulin gene libraries displayed on phage, and transgenic non-human animals such as mice or rats carrying human immunoglobulin loci. "Human antibody" typically contains amino acid differences when compared to the immunoglobulins expressed in humans due to differences between the systems used to obtain the human antibody and human immunoglobulin loci, introduction of somatic mutations or intentional introduction of substitutions into the frameworks or CDRs, or both. Typically, "human antibody" is at least about 80%, 81%, 82%, 83%, 84%, 85%, 86%, 87%, 88%, 89%, 90%, 91%, 92%, 93%, 94%, 95%, 96%, 97%, 98% or 99% identical in amino acid sequence to an amino acid sequence encoded by human germline immunoglobulin or rearranged immunoglobulin genes. In some cases, "human antibody" may contain consensus framework sequences derived from human framework sequence analyses, for example as described in Knappik et al., (2000) J Mol Biol 296:57-86, or synthetic HCDR3 incorporated into human immunoglobulin gene libraries displayed on phage, for example as described in Shi et al., (2010) J Mol Biol 397:385-96, and in Int. Patent Publ. No. WO2009/085462.

"Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared. For purposes herein, however, % amino acid sequence identify values are generated using the sequence comparison computer program ALIGN-2. The ALIGN-2 sequence comparison computer program was authored by Genentech. Inc., and the source code has been filed with user documentation in the U.S. Copyright Office, Washington D.C., 20559, where it is registered under U.S. Copyright Registration No. TXU510087. The ALIGN-2 program is publicly available from Genentech. Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary. Where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y,$$

where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

Antibodies in which antigen binding sites are derived from a non-human species are not included in the definition of "human antibody".

"Recombinant" refers to DNA, antibodies and other proteins that are prepared, expressed, created or isolated by recombinant means when segments from different sources are joined to produce recombinant DNA, antibodies or proteins.

"Epitope" refers to a portion of an antigen to which an antibody specifically binds. Epitopes typically consist of chemically active (such as polar, non-polar or hydrophobic) surface groupings of moieties such as amino acids or polysaccharide side chains and may have specific three-dimensional structural characteristics, as well as specific charge characteristics. An epitope may be composed of contiguous and/or discontiguous amino acids that form a conformational spatial unit. For a discontiguous epitope, amino acids from differing portions of the linear sequence of the antigen come in close proximity in 3-dimensional space through the folding of the protein molecule. Antibody "epitope" depends on the methodology used to identify the epitope.

"Paratope" refers to a portion of an antibody to which an antigen specifically binds. A paratope may be linear in nature or may be discontinuous, formed by a spatial relationship between non-contiguous amino acids of an antibody rather than a linear series of amino acids. A "light chain paratope" and a "heavy chain paratope" or "light chain paratope amino acid residues" and "heavy chain paratope amino acid residues" refer to antibody light chain and heavy chain residues in contact with an antigen, respectively, or in general, "antibody paratope residues" refer to those antibody amino acids that are in contact with antigen.

"Bispecific" refers to an antibody that specifically binds two distinct antigens or two distinct epitopes within the same antigen. The bispecific antibody may have cross-reactivity to other related antigens, for example to the same antigen from other species (homologs), such as human or monkey, for example *Macaca fascicularis* (cynomolgus, cyno) or *Pan troglodytes*, or may bind an epitope that is shared between two or more distinct antigens.

"Multispecific" refers to an antibody that specifically binds two or more distinct antigens or two or more distinct epitopes within the same antigen. The multispecific antibody may have cross-reactivity to other related antigens, for example to the same antigen from other species (homologs), such as human or monkey, for example *Macaca fascicularis* (cynomolgus, cyno) or *Pan troglodytes*, or may bind an epitope that is shared between two or more distinct antigens.

"Variant" refers to a polypeptide or a polynucleotide that differs from a reference polypeptide or a reference polynucleotide by one or more modifications, for example one or more substitutions, insertions or deletions.

"Vector" refers to a polynucleotide capable of being duplicated within a biological system or that can be moved between such systems. Vector polynucleotides typically contain elements, such as origins of replication, promoter, polyadenylation signal and selection markers, that function to facilitate the duplication or maintenance of these polynucleotides in a biological system, such as a cell, virus, animal, plant, and reconstituted biological systems utilizing biological components capable of duplicating a vector. The vector polynucleotide may be DNA or RNA molecules or a hybrid of these, single stranded or double stranded.

"Expression vector" refers to a vector that can be utilized in a biological system or in a reconstituted biological system to direct the translation of a polypeptide encoded by a polynucleotide sequence present in the expression vector.

"Polynucleotide" refers to a molecule comprising a chain of nucleotides covalently linked by a sugar-phosphate backbone or other equivalent covalent chemistry. Double and single-stranded DNA and RNA are typical examples of polynucleotides. "Polynucleotide" may refer to a synthetic molecule comprising a chain of nucleotides covalently linked by a sugar-phosphate backbone or other equivalent covalent chemistry. cDNA is an exemplary synthetic polynucleotide.

"Polypeptide" or "protein" refers to a molecule that comprises at least two amino acid residues linked by a peptide bond to form a polypeptide. Small polypeptides of less than 50 amino acids may be referred to as "peptides".

"Flow cytometry" is a technology that is used to analyze the physical and chemical characteristics of particles in a fluid as it passes through at least one laser. Cell components are fluorescently labelled and then excited by the laser to emit light at varying wavelengths (Adan, et al, Critical Reviews in Biotechnology (2016) 1549-7801).

"Anti-idiotypic (anti-Id) antibody" is an antibody that recognizes the antigenic determinants (e.g. the paratope or CDRs) of the antibody. It is generally known in the art the process of producing or preparing an anti-idiotypic antibody. (Lathey, J. et al Immunology 1986 57(1):29-35). The anti-Id antibody may be antigen-blocking or non-blocking. The antigen-blocking anti-Id antibody may be used to detect the free antibody in a sample, e.g. CD3. The non-blocking anti-Id antibody may be used to detect the total antibody (free, partially bound to antigen, or fully bound to antigen) in a sample. An anti-Id antibody may be prepared by immunizing an animal with the antibody to which an anti-Id antibody is being prepared. In some embodiments described herein, the anti-idiotypic antibody is used for detecting the level of the therapeutic antibodies in a sample.

An anti-Id antibody may also be used as an immunogen to induce an immune response in yet another animal, producing a so-called anti-anti-Id antibody. An anti-anti-Id antibody may be epitopically identical to the original mAb, which induced the anti-Id antibody. Thus, by using antibodies to the idiotypic determinants of a mAb, it is possible to identify other clones expressing antibodies of identical specificity. Anti-Id antibodies may be varied (thereby producing anti-Id antibody variants) and/or derivatized by any suitable technique, such as those described elsewhere herein with respect to the anti-CD3 antibodies.

PSMA refers to Prostate Specific Membrane Antigen. The amino acid sequence of *Pan troglodytes* (also referred to as chimpanzee or chimp) PSMA is shown in SEQ ID NO: 49. The extracellular domain spans residues 44-750, the transmembrane domain spans residues 20-43 and the cytoplasmic domain spans residues 1-19 of SEQ ID NO: 49. The amino acid sequence of the *Macaca fascicularis* (also referred to as cynomolgus monkey, macaque or cyno) PSMA is shown in SEQ ID NO: 50. The extracellular domain spans residues 44-750, the transmembrane domain spans residues 20-43 and the cytoplasmic domain spans residues 1-19 of SEQ ID NO: 50. The amino acid sequence of the human PSMA is shown in SEQ ID NO:51. The extracellular domain spans residues 44-750, the transmembrane domain spans residues 20-43 and the cytoplasmic domain spans residues 1-19 of SEQ ID NO:51.

Throughout the specification, "CD3-specific" or "specifically binds CD3" or "anti-CD3 antibody" refers to antibodies that bind specifically to the CD3-epsilon polypeptide (SEQ ID NO:635), including antibodies that bind specifically to the CD3-epsilon extracellular domain (ECD) (SEQ ID NO:636). CD3-epsilon, together with CD3-gamma, -delta and -zeta, and the T-cell receptor alpha/beta and gamma/delta heterodimers, forms the T-cell receptor-CD3 complex. This complex plays an important role in coupling antigen recognition to several intracellular signal-transduction pathways. The CD3 complex mediates signal transduction, resulting in T cell activation and proliferation. CD3 is required for the immune response.

(Human CD3 epsilon)
SEQ ID NO: 635
MQSGTHWRVLGLCLLSVGVWGQDGNEEMGGITQTPYKVSISGTTVILTCPQ

YPGSEILWQHNDKNIGGDEDDKNIGSDEDHLSLKEFSELEQSGYYVCYPRG

-continued
SKPEDANFYLYLRARVCENCMEMDVMSVATIVIVDICITGGLLLLVYYWSK

NRKAKAKPVTRGAGAGGRQRGQNKERPPPVPNPDYEPIRKGQRDLYSGLNQ

RRI (Human CD3 epsilon extracellular domain)
SEQ ID NO: 636
DGNEEMGGITQTPYKVSISGTTVILTCPQYPGSEILWQHNDKNIGGDEDDK

NIGSDEDHLSLKEFSELEQSGYYVCYPRGSKPEDANFYLYLRARVCENCME

MD

As used herein, the terms "interleukin-1 receptor accessory protein", "IL1RAP" and "IL1-RAP" specifically include the human IL1RAP protein, for example as described in GenBank Accession No. AAB84059, NCBI Reference Sequence: NP_002173.1 and UniProtKB/Swiss-Prot Accession No. Q9NPH3-1 (see also Huang et al., 1997, Proc. Natl. Acad. Sci. USA. 94 (24), 12829-12832). IL1RAP is also known in the scientific literature as IL1 R3, C3orf13, FLJ37788, IL-1 RAcP and EG3556.

"CD33" refers to cluster of differentiation 33 protein. CD33 is a 67 kilodalton (kD) single pass transmembrane glycoprotein and is a member of the sialic acid-binding immunoglobulin-like lectins (Siglecs) family. CD33 is primarily considered to be a myeloid differentiation antigen, with low expression in myeloid progenitors, neutrophils and macrophages and high expression in circulating monocytes and dendritic cells. Human CD33 extracellular domain (Uniprot P20138) (SEQ ID NO:636) and cynomolgus CD33 (XP_005590138.1) are examples of proteins for use in generating CD33-specific antibodies according to the present disclosure.

"TMEFF2" refers to human transmembrane protein with EGF like and two follistatin like domains 2, also called tomoregulin 2. The amino acid sequence of the full length human TMEFF2 is shown in SEQ ID NO: 77. The extracellular domain of TMEFF2 is shown in SEQ ID NO: 575 and spans residues 40-374 of the full length TMEFF2. TMEFF2 extracellular domain harbors three distinct subdomains, the Kazal-like 1 (residues 85-137), the Kazal-like 2 (residues 176-229) and the EGF domain (residues 261-301). The TMEFF2 EGF domain is shown in SEQ ID NO: 577. The TMEFF2 "membrane proximal region" refers to the TMEFF2 region of SEQ ID NO: 629, which encompasses the EGF domain and the N- C-terminal linker regions (e.g. residues 230-320 of full length human TMEFF2 of SEQ ID NO: 77). All references to proteins, polypeptides and protein fragments herein are intended to refer to the human version of the respective protein, polypeptide or protein fragment unless explicitly specified as being from a non-human species. Thus, "TMEFF2" means human TMEFF2 unless specified as being from a non-human species, e.g., "mouse TMEFF2" or "monkey TMEFF2" etc.

(full length human TMEFF2)
SEQ ID NO: 77
MVLWESPRQCSSWTLCEGFCWLLLLPVMLLIVARPVKLAAFPTSLSDCQTP

TGWNCSGYDDRENDLFLCDTNTCKFDGECLRIGDTVTCVCQFKCNNDYVPV

CGSNGESYQNECYLRQAACKQQSEILVVSEGSCATDAGSGSGDGVHEGSGE

TSQKETSTCDICQFGAECDEDAEDVWCVCNIDCSQTNFNPLCASDGKSYDN

ACQIKEASCQKQEKIEVMSLGRCQDNTTTTTKSEDGHYARTDYAENANKLE

ESAREHHIPCPEHYNGFCMHGKCEHSINMQEPSCRCDAGYTGQHCEKKDYS

VLYVVPGPVRFQYVLIAAVIGTIQIAVICVVVLCITRKCPRSNRIHRQKQN

TGHYSSDNTTRASTRLI (extracellular domain of human TMEFF2)
SEQ ID NO: 575
FPTSLSDCQTPTGWNCSGYDDRENDLFLCDTNTCKFDGECLRIGDTVTCVC

QFKCNNDYVPVCGSNGESYQNECYLRQAACKQQSEILVVSEGSCATDAGSG

SGDGVHEGSGETSQKETSTCDICQFGAECDEDAEDVWCVCNIDCSQTNFNP

LCASDGKSYDNACQIKEASCQKQEKIEVMSLGRCQDNTTTTTKSEDGHYAR

TDYAENANKLEESAREHHIPCPEHYNGECMHGKCEHSINMQEPSCRCDAGY

TGQHCEKKDYSVLYVVPGPVRFQYVLIAAVIGTIQIAVICVVVLCITRKCP

RSNRIHRQKQNTGHYSSDNTTRASTRLI

TMEFF2 EGF domain
SEQ ID NO: 577
HHIPCPEHYNGFCMHGKCEHSINMQEPSCRCDAGYTGQHCE

TMEFF2 membrane proximal region
SEQ ID NO: 629
NTTTTTKSEDGHYARTDYAENANKLEESAREHHIPCPEHYNGFCMHGKCEH

SINMQEPSCRCDAGYTGQHCEKKDYSVLYVVPGPVRFQYV

"TMEFF2 positive cancer" refers to a cancer tissue or a cancer cell that displays measurable level of TMEFF2 protein. Level of TMEFF2 protein may be measured using well known assays using, for example ELISA, immunofluorescence, flow cytometry or radioimmunoassay on live or lysed cells. "Overexpress", "overexpressed" and "overexpressing" interchangeably refers to a sample such as a cancer cell, malignant cell or cancer tissue that has measurably higher levels of tumor antigen when compared to a reference sample. The overexpression may be caused by gene amplification or by increased transcription or translation. Expression and overexpression of protein in the sample may be measured using well-known assays using, for example ELISA, immunofluorescence, flow cytometry or radioimmunoassay on live or lysed cells. Expression and overexpression of a polynucleotide in the sample may be measured, for example, using fluorescent in situ hybridization, Southern blotting, or PCR techniques. A protein or a polynucleotide is overexpressed when the level of the protein or the polynucleotide in the sample is at least 1.5-fold higher when compared to the reference sample. Selection of the reference sample is well known.

"Sample" refers to a collection of similar fluids, cells, or tissues isolated from a subject, as well as fluids, cells, or tissues present within a subject. Exemplary samples are biological fluids such as blood, serum and serosal fluids, plasma, lymph, urine, saliva, cystic fluid, tear drops, feces, sputum, mucosal secretions of the secretory tissues and organs, vaginal secretions, ascites fluids such as those associated with non-solid tumors, fluids of the pleural, pericardial, peritoneal, abdominal and other body cavities, fluids collected by bronchial lavage, liquid solutions contacted with a subject or biological source, for example, cell and organ culture medium including cell or organ conditioned medium, lavage fluids and the like, tissue biopsies, fine needle aspirations or surgically resected tumor tissue.

A "cancer cell" or a "tumor cell" as used herein refers to a cancerous, pre-cancerous or transformed cell, either in vivo, ex vivo, or in tissue culture, that has spontaneous or induced phenotypic changes. These changes do not necessarily involve the uptake of new genetic material. Although transformation may arise from infection with a transforming virus and incorporation of new genomic nucleic acid or uptake of exogenous nucleic acid, it can also arise spontaneously or following exposure to a carcinogen, thereby mutating an endogenous gene. Transformation/cancer is exemplified by morphological changes, immortalization of cells, aberrant growth control, foci formation, proliferation, malignancy, modulation of tumor specific marker levels, invasiveness, tumor growth in suitable animal hosts such as nude mice, and the like, in vitro, in vivo, and ex vivo (Freshney, Culture of Animal Cells: A Manual of Basic Technique (3rd ed. 1994)).

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

"Effector antigens" are antigens from cells of the immune system that can stimulate or trigger cytotoxicity, phagocytosis, antigen presentation, and/or cytokine release. Such effector antigens are from, for example but not limited to, T cells and natural killer (NK) cells. Examples of suitable specificities for effector antigens include but are not limited to CD3 or CD3 subunits such as CD3ε for T cells and CD16 for NK cells. Such cell surface molecules of effector cells are suitable for mediating cell killing. Effector cells are cells of the immune system that can stimulate or trigger cytotoxicity, phagocytosis, antigen presentation, and/or cytokine release. Such effector cells are, for example but not limited to, T-cells, natural killer (NK) cells, granulocytes, monocytes, macrophages, dendritic cells, and antigen-presenting cells. Examples of suitable specificities for effector cells include but are not limited to CD2, CD3 and CD3 subunits such as CD3e, CD5, CD28 and other components of the T-cell receptor (TCR) for T cells; CD16, CD16A, CD25, CD38, CD44, CD56, CD69, CD94, CD335 (NKp46), CD336 (NKp44), CD337 (NKp30), NKp80, NKG2C and NKG2D, DNAM, NCRs for NK cells; CD18, CD64 and CD89 for granulocytes; CD18, CD32, CD64, CD89 and mannose receptor for monocytes and macrophages; CD64 and mannose receptor for dendritic cells; as well as CD35. In certain embodiments of the inventions, those specificities, i.e. cell surface molecules, of effector cells are suitable for mediating cell killing upon binding of a bispecific or multispecific molecules to such cell surface molecule and, thereby, inducing cytolysis or apoptosis.

"Bispecific CD3 antibody" refers to a molecule comprising at least one binding domain specifically binding CD3 and at least one binding domain specifically binding a second antigen, such as a bispecific antibody comprising a first domain that specifically binds CD3 and a second domain that specifically binds a second antigen. The domains specifically binding CD3 and a second antigen are typically $V_H/V_L$ pairs. The bispecific CD3 antibody may be monovalent in terms of its binding to either CD3 or the second antigen. In some embodiments, the second, or target, antigen is a cell surface antigen that is expressed on a target cell other than an immune effector cell. In some embodiments, the second antigen a tumor associated antigen (TAA). Exemplary TAAs are PSMA, CD33, IL1RAP, and TMEFF2.

"Bispecific PSMA×CD3 antibody", "PSMA/CD3 antibody", "bispecific anti-PSMA×CD3 antibody" or "anti-PSMA/CD3 antibody" and the like refer to a molecule comprising at least one binding domain specifically binding PSMA and at least one binding domain specifically binding CD3. The domains specifically binding PSMA and CD3 are typically $V_H/V_L$ pairs. The bispecific anti-PSMA×CD3 antibody may be monovalent in terms of its binding to either PSMA or CD3.

"Bispecific CD33×CD3 antibody", "CD33/CD3 antibody", "bispecific anti-CD33×CD3 antibody" or "anti-CD33/CD3 antibody" and the like refer to a molecule comprising at least one binding domain specifically binding CD33 and at least one binding domain specifically binding CD3. The domains specifically binding CD33 and CD3 are typically $V_H/V_L$ pairs. The bispecific anti-CD33×CD3 antibody may be monovalent in terms of its binding to either CD33 or CD3.

"Bispecific IL1RAP×CD3 antibody", "IL1RAP/CD3 antibody", "bispecific anti-IL1RAP×CD3 antibody" or "anti-IL1RAP/CD3 antibody" and the like refer to a molecule comprising at least one binding domain specifically binding IL1RAP and at least one binding domain specifically binding CD3. The domains specifically binding IL1RAP and CD3 are typically $V_H/V_L$ pairs. The bispecific anti-IL1RAP×CD3 antibody may be monovalent in terms of its binding to either IL1RAP or CD3.

"Bispecific anti-TMEFF2/anti-CD3 antibody", TMEFF2/CD3 antibody, TMEFF2×CD3 antibody and the like refer to an antibody that binds TMEFF2 and CD3.

"Valent" refers to the presence of a specified number of binding sites specific for an antigen in a molecule. As such, the terms "monovalent", "bivalent", "tetravalent", and "hexavalent" refer to the presence of one, two, four and six binding sites, respectively, specific for an antigen in a molecule. "Multivalent" refers to the presence of two or more binding sites specific for an antigen in a molecule.

"An antigen specific CD4+ or CD8+ T cell" refers to a CD4+ or CD8+ T cell activated by a specific antigen, or immunostimulatory epitope thereof.

"Subject" includes any human or nonhuman animal. "Nonhuman animal" includes all vertebrates, e.g., mammals and non-mammals, such as nonhuman primates, sheep, dogs, cats, horses, cows chickens, amphibians, reptiles, etc. Except when noted, the terms "patient" or "subject" are used interchangeably.

The numbering of amino acid residues in the antibody constant region throughout the specification is according to the EU index as described in Kabat et al., Sequences of Proteins of Immunological Interest, 5th Ed. Public Health Service, National Institutes of Health, Bethesda, Md. (1991), unless otherwise explicitly stated.

TABLE 1

| Conventional one- and three-letter amino acid codes used herein | | |
|---|---|---|
| Amino acid | Three-letter code | One-letter code |
| Alanine | Ala | A |
| Arginine | Arg | R |
| Asparagine | Asn | N |
| Aspartate | Asp | D |
| Cysteine | Cys | C |
| Glutamate | Gln | E |
| Glutamine | Glu | Q |

TABLE 1-continued

Conventional one- and three-letter amino acid codes used herein

| Amino acid | Three-letter code | One-letter code |
|---|---|---|
| Glycine | Gly | G |
| Histidine | His | H |
| Isoleucine | Ile | I |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

Compositions of Matter

The present invention provides anti-CD3 antibodies and antigen-binding fragments thereof, antibodies and antigen-binding fragments thereof that specifically bind PSMA, antibodies and antigen-binding fragments thereof that specifically bind CD33, antibodies and antigen-binding fragments thereof that specifically bind IL1RAP, multispecific antibodies comprising a first domain that specifically binds CD3 and a second domain that specifically binds a second antigen, and multispecific antibodies that specifically bind CD3 and one or more of PSMA, CD33, IL1RAP, and TMEFF2. The present invention provides polypeptides and polynucleotides encoding the antibodies of the invention or complementary nucleic acids thereof, vectors, host cells, and methods of making and using them.

General Aspects of the Antibodies Described Herein

The anti-CD3 antibodies or antigen-binding fragments described herein include variants having single or multiple amino acid substitutions, deletions, or additions that retain the biological properties (e.g., binding affinity or immune effector activity) of the described anti-CD3 antibodies or antigen-binding fragments. In the context of the present invention the following notations are, unless otherwise indicated, used to describe a mutation; i) substitution of an amino acid in a given position is written as e.g. K409R which means a substitution of a Lysine in position 409 with an Arginine; and ii) for specific variants the specific three or one letter codes are used, including the codes Xaa and X to indicate any amino acid residue. Thus, the substitution of Arginine for Lysine in position 409 is designated as: K409R, or the substitution of any amino acid residue for Lysine in position 409 is designated as K409X. In case of deletion of Lysine in position 409 it is indicated by K409*. The skilled person may produce variants having single or multiple amino acid substitutions, deletions, or additions.

These variants may include: (a) variants in which one or more amino acid residues are substituted with conservative or nonconservative amino acids, (b) variants in which one or more amino acids are added to or deleted from the polypeptide, (c) variants in which one or more amino acids include a substituent group, and (d) variants in which the polypeptide is fused with another peptide or polypeptide such as a fusion partner, a protein tag or other chemical moiety, that may confer useful properties to the polypeptide, such as, for example, an epitope for an antibody, a polyhistidine sequence, a biotin moiety and the like. Antibodies or antigen-binding fragments described herein may include variants in which amino acid residues from one species are substituted for the corresponding residue in another species, either at the conserved or nonconserved positions. In other embodiments, amino acid residues at nonconserved positions are substituted with conservative or nonconservative residues. The techniques for obtaining these variants, including genetic (deletions, mutations, etc.), chemical, and enzymatic techniques, are known to persons having ordinary skill in the art.

The antibodies or antigen-binding fragments described herein may be an IgM, an IgD, an IgG, an IgA or an IgE isotype. In some embodiments, the antibody isotype is an IgG1, an IgG2, an IgG3, or an IgG4 isotype. In some embodiments, the antibody is an IgG1 isotype. In some embodiments, the antibody is an IgG2 isotype. In some embodiments, the antibody is an IgG3 isotype. In some embodiments, the antibody is an IgG4 isotype. The specificity of the antibody or antigen-binding fragment thereof is in part determined by the amino acid sequence and arrangement of the CDRs. Therefore, the CDRs of one isotype may be transferred to another isotype without altering antigen specificity. Accordingly, such antibody isotypes are within the scope of the described antibodies or antigen-binding fragments.

The IgG class is divided in four isotypes: IgG1, IgG2, IgG3 and IgG4 in humans. They share more than 95% homology in the amino acid sequences in the CH1, CH2 and CH3 regions but show major differences in the amino acid composition and structure of the hinge region. The Fc region mediates effector functions, such as antibody-dependent cellular cytotoxicity (ADCC), antibody-dependent cellular phagocytosis (ADCP) and complement-dependent cytotoxicity (CDC). In ADCC, the Fc region binds to Fc receptors (FcγRs) on the surface of immune effector cells such as natural killer cells and macrophages, leading to the lysis of the targeted cells. In CDC, the antibodies mediate targeted cell killing by triggering the complement cascade at the cell surface. In ADCP, the antibody mediates elimination of antibody-coated target cells by internalization by phagocytic cells, such as macrophages or dendritic cells. The antibodies described herein include antibodies with the described features of the variable domains in combination with any of the IgG isotypes, including modified versions in which the Fc region has been modified to modulate the various effector functions.

For many applications of therapeutic antibodies, Fc-mediated effector functions are not desired as they may potentially pose a safety risk due to cell depletion. Modifying effector functions can be achieved by engineering the Fc regions to reduce their binding to FcγRs or the complement factors. The binding of IgG to the activating (FcγRI, FcγRIIa, FcγRIIIa and FcγRIIIb) and inhibitory (FcγRIIb) FcγRs or the first component of complement (C1q) depends on residues located in the hinge region and the CH2 domain. Mutations may be introduced in IgG1, IgG2 and IgG4 to reduce or silence Fc-mediated effector functions. The antibodies described herein may include these modifications.

In some embodiments, the anti-CD3, the anti-PSMA, the anti-CD33, and/or the anti-IL1RAP antibodies comprise an engineered Fc region having one or more of the following properties: (a) reduced effector function when compared to the parental Fc; (b) reduced affinity to FcγRI, FcγRIIa, FcγRIIb, FcγRIIIb and/or FcγRIIIa; (c) reduced affinity to FcγRI; (d) reduced affinity to FcγRIIa; (e) reduced affinity to FcγRIIIb; or (f) reduced affinity to FcγRIIIa.

In some embodiments, the anti-CD3, the anti-PSMA, the anti-CD33, and/or the anti-IL1RAP antibodies are, e.g., IgG1, IgG2, IgG3, or IgG4 isotypes. In some embodiments wherein the antibody has an IgG4 isotype, the antibody contains S228P, F234A, and L235A substitutions in its Fc region when compared to the wild-type IgG4. In some embodiments wherein the antibody has an IgG1 isotype, the antibody contains L234A, and L235A substitutions in its Fc region. The antibodies described herein may include these modifications.

In some embodiments, the anti-CD3, the anti-PSMA, the anti-CD33, and/or the anti-IL1RAP antibodies are an IgG4 isotype, optionally comprising a heavy chain substitution S228P.

In some embodiments, the anti-CD3, the anti-PSMA, the anti-CD33, and/or the anti-IL1RAP antibodies are an IgG1 isotype, optionally comprising heavy chain substitutions L234A, G237A, P238S, H268A, A330S and P331S when compared to the wild type IgG1.

In some embodiments, the anti-CD3, the anti-PSMA, the anti-CD33, and/or the anti-IL1RAP antibodies are an IgG2 isotype, optionally comprising heavy chain substitutions L234A, G237A, P238S, H268A, V309L, A330S and P331S when compared to the wild type IgG2.

```
Wild-type IgG4
                                      (SEQ ID NO: 602)
ASTKGPSVFPLAPCSRSTSESTAALGCLVKDYFPEPVTVSWNSGALTSGVH

TFPAVLQSSGLYSLSSVVTVPSSSLGTKTYTCNVDHKPSNTKVDKRVESKY

GPPCPSCPAPEFLGGPSVFLFPPKPKDTLMISRTPEVTCVVVDVSQEDPEV

QFNWYVDGVEVHNAKTKPREEQFNSTYRVVSVLTVLHQDWLNGKEYKCKVS

NKGLPSSIEKTISKAKGQPREPQVYTLPPSQEEMTKNQVSLTCLVKGFYPS

DIAVEWESNGQPENNYKTTPPVLDSDGSFFLYSRLTVDKSRWQEGNVFSCS

VMHEALHNHYTQKSLSLSLGK

Wild-type IgG1
                                      (SEQ ID NO: 601)
ASTKGPSVFPLAPSSKSTSGGTAALGCLVKDYFPEPVTVSWNSGALTSGVH

TFPAVLQSSGLYSLSSVVTVPSSSLGTQTYICNVNHKPSNTKVDKKVEPKS

CDKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYKC

KVSNKALPAPIEKTISKAKGQPREPQVYTLPPSRDELTKNQVSLTCLVKGF

YPSDIAVEWESNGQPENNYKTTPPVLDSDGSFFLYSKLTVDKSRWQQGNVF

SCSVMHEALHNHYTQKSLSLSPGK

Wild-type IgG2
                                      (SEQ ID NO: 711)
ASTKGPSVFPLAPCSRSTSESTAALGCLVKDYFPEPVTVSWNSGALTSGVH

TFPAVLQSSGLYSLSSVVTVPSSNFGTQTYTCNVDHKPSNTKVDKTVERKC

CVECPPCPAPPVAGPSVFLFPPKPKDTLMISRTPEVTCVVVDVSHEDPEVQ

FNWYVDGVEVHNAKTKPREEQFNSTFRVVSVLTVVHQDWLNGKEYKCKVSN

KGLPAPIEKTISKTKGQPREPQVYTLPPSREEMTKNQVSLTCLVKGFYPSD

ISVEWESNGQPENNYKTTPPMLDSDGSFFLYSKLTVDKSRWQQGNVFSCSV

MHEALHNHYTQKSLSLSPGK
```

In certain embodiments, labelled anti-CD3, anti-PSMA, anti-CD33, and/or anti-IL1RAP antibodies are provided. Exemplary labels or moieties that are detected directly (e.g., fluorescent, chromophoric, electron-dense, chemiluminescent, and radioactive labels) and labels and moieties (e.g., enzymes or ligands) that are detected indirectly (e.g., through enzymatic reaction or molecular interaction). Exemplary labels include radiolabels (e.g., $^{32}P$ $^{14}C$, $^{111}I$, $^{125}I$, $^{3}H$, $^{131}I$), fluorescent labels (such as DyLight® 649), epitope tags, biotin, chromophore labels, ECL labels, or enzymes. More specifically, the described labels include ruthenium, $^{111}In$-DOTA, $^{111}In$-diethylenetriaminepentaacetic acid (DTPA), horseradish peroxidase, alkaline phosphatase and beta-galactosidase, poly-histidine (HIS tag), acridine dyes, cyanine dyes, fluorone dyes, oxazin dyes, phenanthridine dyes, rhodamine dyes, Alexafluor® dyes, and the like.

In addition to the described anti-CD3, anti-PSMA, anti-CD33, and/or anti-IL1RAP antibodies and antigen-binding fragments, also provided are polynucleotide sequences capable of encoding the described antibodies and antigen-binding fragments. Vectors comprising the described polynucleotides are also provided, as are cells expressing the anti-CD3, anti-PSMA, anti-CD33, and/or anti-IL1RAP antibodies or antigen-binding fragments provided herein. Also described are cells capable of expressing the disclosed vectors. These cells may be mammalian cells (such as 293F cells, CHO cells), insect cells (such as Sf7 cells), yeast cells, plant cells, or bacteria cells (such as E. coli). The described antibodies may also be produced by hybridoma cells.

Generation of Monospecific Antibodies

In some embodiments, the anti-CD3, the anti-PSMA, the anti-CD33, the anti-TMEFF2, and/or the anti-IL1RAP antibodies of the invention are human.

In some embodiments, the anti-CD3, the anti-PSMA, the anti-CD33, the anti-TMEFF2, and/or the anti-IL1RAP antibodies of the invention are humanized.

Monospecific antibodies of the invention described herein (e.g. the anti-CD3, the anti-PSMA, the anti-CD33, the anti-TMEFF2, and/or the anti-IL1RAP antibodies) may be generated using various technologies. For example, the hybridoma method of Kohler and Milstein, Nature 256:495, 1975 may be used to generate monoclonal antibodies. In the hybridoma method, a mouse or other host animal, such as a hamster, rat or chicken, is immunized with human, chimpanzee, or macaque PSMA, CD33, IL1RAP, TMEFF2, or CD3 or fragments of PSMA, CD33, IL1RAP, TMEFF2, or CD3, such as the extracellular domain of PSMA, CD33, IL1RAP, TMEFF2, or CD3, followed by fusion of spleen cells from immunized animals with myeloma cells using standard methods to form hybridoma cells (Goding, Monoclonal Antibodies: Principles and Practice, pp. 59-103 (Academic Press, 1986)). Colonies arising from single immortalized hybridoma cells are screened for production of antibodies with desired properties, such as specificity of binding, cross-reactivity or lack thereof, and affinity for the antigen.

Various host animals may be used to produce the anti-CD3, the anti-PSMA, the anti-CD33, TMEFF2, and/or the anti-IL1RAP antibodies of the invention described herein. For example, Balb/c mice may be used to generate mouse anti-human PSMA antibodies. The antibodies made in Balb/c mice and other non-human animals may be humanized using various technologies to generate more human-like sequences.

Exemplary humanization techniques including selection of human acceptor frameworks are known and include CDR grafting (U.S. Pat. No. 5,225,539), SDR grafting (U.S. Pat. No. 6,818,749), Resurfacing (Padlan, (1991) Mol Immunol 28:489-499), Specificity Determining Residues Resurfacing (U.S. Patent Publ. No. 2010/0261620), human framework adaptation (U.S. Pat. No. 8,748,356) or superhumanization (U.S. Pat. No. 7,709,226). In these methods, CDRs of parental antibodies are transferred onto human frameworks that may be selected based on their overall homology to the parental frameworks, based on similarity in CDR length, or canonical structure identity, or a combination thereof.

Humanized antibodies may be further optimized to improve their selectivity or affinity to a desired antigen by incorporating altered framework support residues to preserve binding affinity (backmutations) by techniques such as those described in Int. Patent Publ. Nos. WO1090/007861 and WO1992/22653, or by introducing variation at any of the CDRs for example to improve affinity of the antibody.

Transgenic animals, such as mice or rat carrying human immunoglobulin (Ig) loci in their genome may be used to generate human antibodies against a target protein, and are described in for example U.S. Pat. No. 6,150,584, Int. Patent Publ. No. WO99/45962, Int. Patent Publ. Nos. WO2002/066630, WO2002/43478, WO2002/043478 and WO1990/04036, Lonberg et al (1994) Nature 368:856-9; Green et al (1994) Nature Genet. 7:13-21; Green & Jakobovits (1998) Exp. Med. 188:483-95; Lonberg and Huszar (1995) Int Rev Immunol 13:65-93; Bruggemann et al., (1991) Eur J Immunol 21:1323-1326; Fishwild et al., (1996) Nat Biotechnol 14:845-851; Mendez et al., (1997) Nat Genet 15:146-156; Green (1999) J Immunol Methods 231:11-23; Yang et al., (1999) Cancer Res 59:1236-1243; Bruggemann and Taussig (1997) Curr Opin Biotechnol 8:455-458. The endogenous immunoglobulin loci in such animal may be disrupted or deleted, and at least one complete or partial human immunoglobulin locus may be inserted into the genome of the animal using homologous or non-homologous recombination, using transchromosomes, or using minigenes. Companies such as Regeneron (http://_www_regeneron_com), Harbour Antibodies (http://_www_harbourantibodies_com), Open Monoclonal Technology, Inc. (OMT) (http://_www_omtinc_net), KyMab (http://_www_kymab_com), Trianni (http://_www.trianni_com) and Ablexis (http://_www_ablexis_com) may be engaged to provide human antibodies directed against a selected antigen using technologies as described above.

Human antibodies may be selected from a phage display library, where the phage is engineered to express human immunoglobulins or portions thereof such as Fabs, single chain antibodies (scFv), or unpaired or paired antibody variable regions (Knappik et al., (2000) J Mol Biol 296:57-86; Krebs et al., (2001) J Immunol Meth 254:67-84; Vaughan et al., (1996) Nature Biotechnology 14:309-314; Sheets et al., (1998) PITAS (USA) 95:6157-6162; Hoogenboom and Winter (1991) J Mol Biol 227:381; Marks et al., (1991) J Mol Biol 222:581). The antibodies of the invention may be isolated for example from phage display library expressing antibody heavy and light chain variable regions as fusion proteins with bacteriophage pIX coat protein as described in Shi et al., (2010) J Mol Biol 397:385-96, and Int. Patent Publ. No. WO09/085462). The libraries may be screened for phage binding to human and/or cyno PSMA, CD33, IL1RAP, TMEFF2, or CD3 and the obtained positive clones may be further characterized, the Fabs isolated from the clone lysates, and expressed as full length IgGs. Such phage display methods for isolating human antibodies are described in for example: U.S. Pat. Nos. 5,223,409, 5,403,484, 5,571,698, 5,427,908, 5,580,717, 5,969,108, 6,172,197, 5,885,793; 6,521,404; 6,544,731; 6,555,313; 6,582,915 and 6,593,081.

Preparation of immunogenic antigens and monoclonal antibody production may be performed using any suitable technique, such as recombinant protein production. The immunogenic antigens may be administered to an animal in the form of purified protein, or protein mixtures including whole cells or cell or tissue extracts, or the antigen may be formed de novo in the animal's body from nucleic acids encoding said antigen or a portion thereof.

Generation and Use of Bispecific and Multispecific CD3 Antibodies

The invention provides bispecific and multispecific antibodies comprising a first domain that specifically binds CD3 and a second domain that specifically binds a second antigen. The second antigen may be a tumor associated antigen (TAA) or an antigen on pathogenic cells.

Exemplary anti-CD3 antibodies that may be used to engineer bispecific and multispecific antibodies comprising a first domain that specifically binds CD3 and a second domain that specifically binds a second antigen include CD3 antibodies comprising the $V_H/V_L$ sequences and heavy/light chain CDRs shown in Table 7A and 7B, respectively, and the engineered variants thereof described in Table 10 and Table 11, and accompanying text. For example, the CDRs and/or the VH/VL domains of the CD3 antibodies CD3B312, CD3B313, CD3B314, CD3B315, CD3B316, CD3B317, CD3B337, CD3B373, CD3B376, CD3B389, CD3B450, and CD3B467 described herein may be used to generate bispecific and multispecific antibodies comprising a first domain that specifically binds CD3 and a second domain that specifically binds a second antigen.

The herein described anti-CD3 antibody CDRs and/or the VH/VL domains may be incorporated into bispecific antibodies comprising a first domain that specifically binds CD3 and a second domain that specifically binds a second antigen.

The herein described anti-CD3 antibody CDRs and/or the VH/VL domains may be incorporated into bispecific antibodies comprising PSMA binding VH/VL domains described herein and in Table 23. The herein described anti-CD3 antibodies and/or the VH/VL domains may be incorporated into bispecific antibodies comprising IL1RAP binding VH/VL domains described herein and in Table 30. The herein described anti-CD3 antibody CDRs and/or the VH/VL domains may be incorporated into bispecific antibodies comprising CD33 binding VH/VL domains described herein and in Table 38. For example, the VH/VL domains of the PSMA antibodies PSMB119, PSMB120, PSMB121, PSMB122, PSMB123, PSMB87, PSMB126, PSMB127, PSMB128, PSMB129, PSMB130, PSMB120, PSMB121, PSMB122, PSMB123, PSMB127, PSMB128, PSMB130, PSMB344, PSMB345, PSMB346, PSMB347, PSMB349, PSMB358, PSMB359, PSMB360, PSMB361, PSMB362, PSMB363, and PSMB365 described herein may be used to generate bispecific PSMAxCD3 antibodies.

Exemplary TAAs are PSMA, CD33, TMEFF2, and IL1RAP. The exemplary multispecific PSMAxCD3, CD33x CD3, TMEFF2, xCD3, and IL1RAPxCD3 antibodies provided herein have a first domain that specifically bind CD3 and a second domain that specifically binds PSMA, CD33, TMEFF2, or IL1RAP. Exemplary anti-PSMA antibodies that may be used to engineer bispecific PSMAxCD3 molecules are those described herein, which may comprise heavy and light chain sequences including but not limited to the heavy and light chain sequences listed in Table 23. Exemplary anti-IL1RAP antibodies that may be used to engineer bispecific IL1RAPxCD3 molecules are those described herein, which may comprise heavy and light chain variable region sequences including but not limited to the heavy and light chain variable region sequences provided in Table 35. Exemplary anti-CD33 antibodies that may be used to engineer bispecific CD33xCD3 molecules are those described herein, which may comprise heavy and light chain variable region sequences including but not limited to the heavy and light chain variable region sequences provided in Table 43. Exemplary anti-TMEFF2 antibodies that may be used to engineer bispecific TMEFF2×CD3 molecules are those described herein, which may comprise heavy and light chain variable region sequences including but not limited to the heavy and light chain variable region sequences provided in Tables 59, 66-68.

The generated bispecific antibodies may be tested for their binding to CD3 and/or the second antigen and/or for their desired functional characteristics, such as T-cell mediated killing of cells that express the second antigen.

The bispecific antibodies provided herein include antibodies having a full-length antibody structure.

"Fab-arm" or "half molecule" refers to one heavy chain-light chain pair that specifically binds an antigen.

Full length bispecific antibodies as described herein may be generated for example using Fab arm exchange (or half molecule exchange) between two monospecific bivalent antibodies by introducing substitutions at the heavy chain CH3 interface in each half molecule to favor heterodimer formation of two antibody half molecules having distinct specificity either in vitro in cell-free environment or using co-expression. The Fab arm exchange reaction is the result of a disulfide-bond isomerization reaction and dissociation-association of CH3 domains. The heavy chain disulfide bonds in the hinge regions of the parental monospecific antibodies are reduced. The resulting free cysteines of one of the parental monospecific antibodies form an inter heavy-chain disulfide bond with cysteine residues of a second parental monospecific antibody molecule and simultaneously CH3 domains of the parental antibodies release and reform by dissociation-association. The CH3 domains of the Fab arms may be engineered to favor heterodimerization over homodimerization. The resulting product is a bispecific antibody having two Fab arms or half molecules, which each bind a distinct epitope, i.e. an epitope on CD3 and an epitope on the second antigen.

"Homodimerization" refers to an interaction of two heavy chains having identical CH3 amino acid sequences. "Homodimer" refers to an antibody having two heavy chains with identical CH3 amino acid sequences.

"Heterodimerization" refers to an interaction of two heavy chains having non-identical CH3 amino acid sequences. "Heterodimer" refers to an antibody having two heavy chains with non-identical CH3 amino acid sequences.

In some embodiments, the bispecific antibodies include designs such as the Triomab/Quadroma (Trion Pharma/Fresenius Biotech), Knob-in-Hole (Genentech), CrossMAbs (Roche) and the electrostatically-matched (Chugai, Amgen, NovoNordisk, Oncomed), the LUZ-Y (Genentech), the Strand Exchange Engineered Domain body (SEEDbody) (EMD Serono), the Biclonic (Merus) and the DuoBody® Technology (Genmab A/S).

The Triomab quadroma technology may be used to generate full-length bispecific antibodies, incorporating the VH and VL of the anti-CD3 antibodies of the invention. Triomab technology promotes Fab arm exchange between two parental chimeric antibodies, one parental mAb having IgG2a and the second parental mAb having rat IgG2b constant regions, yielding chimeric bispecific antibodies.

The "knob-in-hole" strategy (see, e.g., Intl. Publ. No. WO 2006/028936) may be used to generate full-length bispecific antibodies. Briefly, selected amino acids forming the interface of the CH3 domains in human IgG can be mutated at positions affecting CH3 domain interactions to promote heterodimer formation. An amino acid with a small side chain (hole) is introduced into a heavy chain of an antibody specifically binding a first antigen and an amino acid with a large side chain (knob) is introduced into a heavy chain of an antibody specifically binding a second antigen. After co-expression of the two antibodies, a heterodimer is formed as a result of the preferential interaction of the heavy chain with a "hole" with the heavy chain with a "knob". Exemplary CH3 substitution pairs forming a knob and a hole are (expressed as modified position in the first CH3 domain of the first heavy chain/modified position in the second CH3 domain of the second heavy chain): T366Y/F405A, T366W/F405W, F405W/Y407A, T394W/Y407T, T394S/Y407A, T366W/T394S, F405W/T394S and T366W/T366S_L368A_Y407V.

The CrossMAb technology may be used to generate full-length bispecific antibodies. CrossMAbs, in addition to utilizing the "knob-in-hole" strategy to promoter Fab arm exchange, have in one of the half arms the CH1 and the CL domains exchanged to ensure correct light chain pairing of the resulting bispecific antibody (see e.g. U.S. Pat. No. 8,242,247).

Other cross-over strategies may be used to generate full length bispecific antibodies by exchanging variable or constant, or both domains between the heavy chain and the light chain or within the heavy chain in the bispecific antibodies, either in one or both arms. These exchanges include for example VH-CH1 with VL-CL, VH with VL, CH3 with CL and CH3 with CH1 as described in Int. Patent Publ. Nos. WO2009/080254, WO2009/080251, WO2009/018386 and WO2009/080252.

Other strategies such as promoting heavy chain heterodimerization using electrostatic interactions by substituting positively charged residues at one CH3 surface and negatively charged residues at a second CH3 surface may be used, as described in US Patent Publ. No. US2010/0015133; US Patent Publ. No. US2009/0182127; US Patent Publ. No. US2010/028637 or US Patent Publ. No. US2011/0123532. In other strategies, heterodimerization may be promoted by following substitutions (expressed as modified position in the first CH3 domain of the first heavy chain/modified position in the second CH3 domain of the second heavy chain): L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/T350V_T366L_K392L_T394W as described in U.S. Patent Publ. No. US2012/0149876 or U.S. Patent Publ. No. US2013/0195849.

LUZ-Y technology may be utilized to generate bispecific antibodies. In this technology, a leucine zipper is added into the C terminus of the CH3 domains to drive the heterodimer assembly from parental mAbs that is removed post-purification as described in Wranik et al., (2012) J Biol Chem 287(52): 42221-9.

SEEDbody technology may be utilized to generate bispecific antibodies. SEEDbodies have, in their constant domains, select IgG residues substituted with IgA residues to promote heterodimerization as described in U.S. Patent No. US20070287170.

The bispecific antibodies described herein may be generated in vitro in a cell-free environment by introducing asymmetrical mutations in the CH3 regions of two monospecific homodimeric antibodies and forming the bispecific heterodimeric antibody from two parent monospecific homodimeric antibodies in reducing conditions to allow disulfide bond isomerization according to methods described in Int. Patent Publ. No. WO2011/131746). In the methods, the first monospecific bivalent antibody (i.e., the antibody that specifically binds the second antigen; e.g., anti-PSMA, anti-CD33, anti-TMEFF2 or anti-IL1RAP antibody) and the second monospecific bivalent antibody (i.e., anti-CD3 antibody) are engineered to have certain substitutions at the CH3 domain that promoter heterodimer stability; the antibodies are incubated together under reducing conditions sufficient to allow the cysteines in the hinge region to undergo disulfide bond isomerization; thereby generating the bispecific antibody by Fab arm exchange. The incubation conditions are restored to non-reducing. Exemplary reducing agents that may be used are 2-mercaptoethylamine (2-MEA), dithiothreitol (DTT), dithioerythritol (DTE), glutathione, tris(2-carboxyethyl)phosphine (TCEP), L-cysteine and beta-mercaptoethanol. For example, incubation for at least 90 min at a temperature of at least 20° C. in the presence of at least 25 mM 2-MEA or in the presence of at least 0.5 mM dithiothreitol at a pH of from 5-8, for example at pH of 7.0 or at pH of 7.4 may be used.

In some embodiments described herein, the bispecific antibody comprising a first domain that specifically binds CD3 and a second domain that specifically binds a second antigen comprises at least one substitution in an antibody CH3 constant domain.

In some embodiments described herein, the at least one substitution in the antibody CH3 constant domain is K409R, F405L or F405L and R409K substitution, wherein residue numbering is according to the EU Index.

Antibody domains and numbering are well known. "Asymmetrical" refers to non-identical substitutions in the two CH3 domains in two separate heavy chains in an antibody. An IgG1 CH3 region typically consists of residues 341-446 on IgG1 (residue numbering according to the EU index).

In some embodiments described herein, the bispecific antibody is an IgG1 isotype and comprises a F405L substitution in an antibody first heavy chain (HC1) and a K409R substitution in an antibody second heavy chain (HC2) when compared to the wild-type IgG1.

In some embodiments described herein, the bispecific antibody is an IgG1 isotype and comprises a K409R substitution in an antibody first heavy chain (HC1) and a F405L substitution in an antibody second heavy chain (HC2) when compared to the wild-type IgG1.

In some embodiments described herein, the bispecific antibody is an IgG4 isotype and comprises a S228P substitution in the HC1 and S228P, F405L and R409K substitutions in the HC2 when compared to the wild-type IgG4.

In some embodiments described herein, the bispecific antibody is an IgG4 isotype and comprises S228P, F405L and R409K substitutions in the HC1 and a S228P substitution in the HC2 when compared to the wild-type IgG4.

In some embodiments described herein, the bispecific antibody is an IgG4 isotype and comprises S228P, F234A and L235A substitutions in the HC1 and S228P, F234A, L235A, F405L and R409K substitutions in the HC2 when compared to the wild-type IgG4.

In some embodiments described herein, the bispecific antibody is an IgG4 isotype and comprises S228P, F234A, L235A, F405L and R409K substitutions in the HC1 and a S228P, F234A and L235A substitutions in the HC2 when compared to the wild-type IgG4.

In some embodiments described herein, the bispecific antibody of the invention comprises at least one, two, three, four, five, six, seven or eight asymmetrical substitutions in the HC1 and the HC2 at residue positions 350, 366, 368, 370, 399, 405, 407 or 409, when residue numbering is according to the EU index.

In some embodiments described herein, the bispecific antibody of the invention comprises at least one, two, three or four asymmetrical substitutions in the HC1 and the HC2 at residue positions 350, 370, 405 or 409, when residue numbering is according to the EU index.

In some embodiments described herein, the bispecific antibody of the invention comprises at least one asymmetrical substitution in the HC1 and the HC2 at residue positions 405 or 409, when residue numbering is according to the EU index.

Substitutions are typically made at the DNA level to a molecule such as the constant domain of the antibody using standard methods.

The antibodies of the invention may be engineered into various well-known antibody forms.

In some embodiments, the bispecific antibody of the present invention is a cross-body.

In some embodiments, the bispecific antibodies of the invention include recombinant IgG-like dual targeting molecules, wherein the two sides of the molecule each contain the Fab fragment or part of the Fab fragment of at least two different antibodies; IgG fusion molecules, wherein full length IgG antibodies are fused to an extra Fab fragment or parts of Fab fragment; Fc fusion molecules, wherein single chain Fv molecules or stabilized diabodies are fused to heavy-chain constant-domains, Fc-regions or parts thereof, Fab fusion molecules, wherein different Fab-fragments are fused together; ScFv- and diabody-based and heavy chain antibodies (e.g., domain antibodies, nanobodies) wherein different single chain Fv molecules or different diabodies or different heavy-chain antibodies (e.g. domain antibodies, nanobodies) are fused to each other or to another protein or carrier molecule.

In some embodiments, recombinant IgG-like dual targeting molecules include Dual Targeting (DT)-Ig (GSK/Domantis), Two-in-one Antibody (Genentech) and mAb2 (F-Star).

In some embodiments, IgG fusion molecules include Dual Variable Domain (DVD)-Ig (Abbott), Ts2Ab (MedImmune/AZ) and BsAb (Zymogenetics), HERCULES (Biogen Idec) and TvAb (Roche).

In some embodiments, Fc fusion molecules include to ScFv/Fc Fusions (Academic Institution), SCORPION (Emergent BioSolutions/Trubion, Zymogenetics/BMS) and Dual Affinity Retargeting Technology (Fc-DART) (MacroGenics).

In some embodiments, Fab fusion bispecific antibodies include F(ab)2 (Medarex/AMGEN), Dual-Action or Bis-Fab (Genentech), Dock-and-Lock (DNL) (ImmunoMedics), Bivalent Bispecific (Biotecnol) and Fab-Fv (UCB-Celltech). ScFv-, diabody-based and domain antibodies include Bispecific T Cell Engager (BITE) (Micromet), Tandem Diabody (Tandab) (Affimed), Dual Affinity Retargeting Technology (DART) (MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), dual targeting heavy chain only domain antibodies. Various formats of bispecific antibodies have been described, for example in Chames and Baty (2009) Curr Opin Drug Disc Dev 12: 276 and in Nunez-Prado et al., (2015) Drug Discovery Today 20(5):588-594.

Table 2 summarizes exemplary monoclonal antibodies described herein that can be used to generate the bispecific antibodies of the invention.

TABLE 2

Exemplary monoclonal antibodies that can be used to generate the bispecific antibodies of the invention

| First Domain | Second Domain | | |
|---|---|---|---|
| anti-CD3 | anti-PSMA | anti-CD33 | anti-IL1RAP |
| CD3B312 | PSMB87 | C33B760 | IAPB3 |
| CD3B313 | PSMB119 | C33B777 | IAPB9 |
| CD3B314 | PSMB120 | C33B778 | IAPB17 |
| CD3B315 | PSMB121 | C33B782 | IAPB23 |
| CD3B316 | PSMB122 | C33B792 | IAPB25 |
| CD3B317 | PSMB123 | C33B799 | IAPB29 |
| CD3B337 | PSMB124 | C33B806 | IAPB38 |
| CD3B373 | PSMB126 | C33B830 | IAPB47 |
| CD3B376 | PSMB127 | C33B836 | IAPB55 |
| CD3B389 | PSMB129 | C33B903 | IAPB57 |
| CD3B450 | PSMB130 | C33B904 | IAPB61 |
| CD3B467 | PSMB344 | C33B905 | IAPB62 |
| | PSMB345 | C33B907 | IAPB63 |
| | PSMB346 | C33B908 | IAPB64 |
| | PSMB347 | | IAPB65 |
| | PSMB349 | | |
| | PSMB358 | | |
| | PSMB359 | | |
| | PSMB360 | | |
| | PSMB361 | | |
| | PSMB362 | | |
| | PSMB363 | | |
| | PSMB365 | | |

Exemplary anti-TMEFF2 antibodies that may be used to engineer bispecific TMEFF2×CD3 molecules are those described herein, which may comprise heavy and light chain variable region sequences including but not limited to the heavy and light chain variable region sequences provided in Tables 59, 66-68.

In some embodiments, the anti-CD3 antibody is a multi-specific antibody, for example a bispecific antibody comprising a first domain that specifically binds CD3 and a second domain that specifically binds a second antigen. In some embodiments, the second, or target, antigen is a cell surface antigen that is expressed on a target cell other than an immune effector cell. In some embodiments, the second antigen is a TAA. Exemplary TAAs are PSMA, CD33, TMEFF2, and IL1RAP.

The invention provides a bispecific antibody comprising a first domain that specifically binds CD3 and a second domain that specifically binds a second antigen.

In some embodiments, the first domain comprises the HCDR1, the HCDR2, the HCDR3, the LCDR1, the LCDR2, and the LCDR3 of SEQ ID NOs:662, 663, 664, 671, 673, and 690, respectively. In some embodiments, the first domain comprises the VH and VL of SEQ ID NOs: 652 and 661, respectively. In some embodiments, the first domain comprises the HC and LC of SEQ ID NOs: 640 and 676, respectively. In some embodiments, the first domain comprises the VH and VL of SEQ ID NOs: 657 and 678, respectively. In some embodiments, the first domain comprises the HC and LC of SEQ ID NOs: 675 and 677, respectively.

In some embodiments, the first domain comprises the HCDR1, the HCDR2, the HCDR3, the LCDR1, the LCDR2, and the LCDR3 of SEQ ID NOs:662, 663, 664, 773, 673, and 690, respectively. In some embodiments, the first domain comprises the VH and VL of SEQ ID NOs:657 and 678, respectively. In some embodiments, the first domain comprises the HC and LC of SEQ ID NOs:675 and 677, respectively.

The invention also provides the bispecific antibody comprising a first domain that specifically binds CD3 and a second domain that specifically binds a second antigen of the invention for use in therapy.

The invention also provides the bispecific antibody comprising a first domain that specifically binds CD3 and a second domain that specifically binds a second antigen of the invention for use in treating a cell proliferative disorder.

The invention also provides the bispecific antibody comprising a first domain that specifically binds CD3 and a second domain that specifically binds a second antigen of the invention for use in treating cancer.

The invention also provides the bispecific antibody comprising a first domain that specifically binds CD3 and a second domain that specifically binds a second antigen of the invention for use in treating an autoimmune disease.

The invention also provides the bispecific antibody comprising a first domain that specifically binds CD3 and a second domain that specifically binds a second antigen of the invention for use in the manufacture of a medicament for treating cancer.

The invention also provides the bispecific antibody comprising a first domain that specifically binds CD3 and a second domain that specifically binds a second antigen of the invention for use in the manufacture of a medicament for treating an autoimmune disorder.

A further aspect of the invention is a method of treating a cell proliferative disorder or an autoimmune disorder in a subject in need thereof, the method comprising administering to the subject a therapeutically effective amount of the anti-CD3 antibody of the invention. In some embodiments, the anti-CD3 antibody or the bispecific antibody comprising a first domain that specifically binds CD3 and a second domain that specifically binds a second antigen of the invention is administered to the subject in a dosage of about 0.01 mg/kg to about 10 mg/kg. In some embodiments, the anti-CD3 antibody or the bispecific antibody comprising a first domain that specifically binds CD3 and a second domain that specifically binds a second antigen of the invention is administered to the subject in a dosage of about 0.1 mg/kg to about 10 mg/kg. In some embodiments, the anti-CD3 antibody or the bispecific antibody comprising a first domain that specifically binds CD3 and a second domain that specifically binds a second antigen of the invention is administered to the subject in a dosage of about 1 mg/kg. In some embodiments, the anti-CD3 antibody or the bispecific antibody comprising a first domain that specifically binds CD3 and a second domain that specifically binds a second antigen of the invention is administered subcutaneously, intravenously, intramuscularly, topically, orally, transdermally, intraperitoneally, intraorbitally, by implantation, by inhalation, intrathecally, intraventricularly, or intranasally. In some embodiments, the anti-CD3 antibody or the bispecific antibody comprising a first domain that specifically binds CD3 and a second domain that specifically binds a second antigen of the invention is administered subcutaneously. In some embodiments, the anti-CD3 antibody or the bispecific antibody comprising a first domain that specifically binds CD3 and a second domain that specifically binds a second antigen of the invention is administered intravenously.

In any of the preceding uses or methods, the cell proliferative disorder is cancer. In some embodiments, the cancer is selected from the group consisting of esophageal cancer, stomach cancer, small intestine cancer, large intestine cancer, colorectal cancer, breast cancer, non-small cell lung cancer, non-Hodgkin's lymphoma (NHL), B cell lymphoma, B cell leukemia, multiple myeloma, renal cancer, prostate cancer, liver cancer, head and neck cancer, melanoma, ovarian cancer, mesothelioma, glioblastoma, germinal-center B-cell-like (GCB) DLBCL, activated B-cell-like (ABC) DLBCL, follicular lymphoma (FL), mantle cell lymphoma (MCL), acute myeloid leukemia (AML), chronic lymphoid leukemia (CLL), marginal zone lymphoma (MZL), small lymphocytic leukemia (SLL), lymphoplasmacytic lymphoma (LL), Waldenstrom macroglobulinemia (WM), central nervous system lymphoma (CNSL), Burkitt's lymphoma (BL), B-cell prolymphocytic leukemia, Splenic marginal zone lymphoma, Hairy cell leukemia, Splenic lymphoma/leukemia, unclassifiable, Splenic diffuse red pulp small B-cell lymphoma, Hairy cell leukemia variant, Waldenstrom macroglobulinemia, Heavy chain diseases, Plasma cell myeloma, Solitary plasmacytoma of bone, Extraosseous plasmacytoma, Extranodal marginal zone lymphoma of mucosa-associated lymphoid tissue (MALT lymphoma), Nodal marginal zone lymphoma, Pediatric nodal marginal zone lymphoma, Pediatric follicular lymphoma, Primary cutaneous follicle centre lymphoma, T-cell/histiocyte rich large B-cell lymphoma, Primary DLBCL of the CNS, Primary cutaneous DLBCL, leg type, EBV-positive DLBCL of the elderly, DLBCL associated with chronic inflammation, Lymphomatoid granulomatosis, Primary mediastinal (thymic) large B-cell lymphoma. Intravascular large B-cell lymphoma, ALK-positive large B-cell lymphoma, Plasmablastic lymphoma, Large B-cell lymphoma arising in HHV8-associated multicentric Castleman disease, Primary effusion lymphoma: B-cell lymphoma, unclassifiable, with features intermediate between diffuse large B-cell lymphoma and Burkitt lymphoma, and B-cell lymphoma, unclassifiable, with features intermediate between diffuse large B-cell lymphoma, classical Hodgkin lymphoma and light chain amyloidosis.

In some embodiments, the cancer is esophageal cancer. In some embodiments, the cancer is an adenocarcinoma, for example, a metastatic adenocarcinoma (e.g., a colorectal adenocarcinoma, a gastric adenocarcinoma, or a pancreatic adenocarcinoma).

In any of the preceding uses or methods, the autoimmune disorder can be selected from the group consisting of rheumatoid arthritis, juvenile rheumatoid arthritis, systemic lupus erythematosus (SLE), Wegener's disease, inflammatory bowel disease, idiopathic thrombocytopenic purpura (ITP), thrombotic thrombocytopenic purpura (TTP), autoimmune thrombocytopenia, multiple sclerosis, psoriasis, IgA nephropathy, IgM polyneuropathies, myasthenia gravis, vasculitis, diabetes mellitus, Reynaud's syndrome, Sjorgen's syndrome, glomerulonephritis, Neuromyelitis Optica (NMO), and IgG neuropathy.

In another aspect, the invention features a kit comprising: (a) a composition comprising any one of the preceding anti-CD3 antibodies or the bispecific antibodies comprising a first domain that specifically binds CD3 and a second domain that specifically binds a second antigen of the invention and (b) a package insert comprising instructions for administering the composition to a subject to treat or delay progression of a cell proliferative disorder. The term "package insert" is used to refer to instructions customarily included in commercial packages of therapeutic products, that contain information about the indications, usage, dosage, administration, combination therapy, contraindications and/or warnings concerning the use of such therapeutic products.

In any of the preceding uses or methods, the subject can be a human.

Polynucleotides, Vectors, and Host Cells

Also disclosed are isolated polynucleotides that encode the anti-CD3 antibodies of the invention or the bispecific antibodies comprising a first domain that specifically binds CD3 and a second domain that specifically binds a second antigen of the invention. The isolated polynucleotides capable of encoding the variable domains provided herein may be included on the same, or different, vectors to produce antibodies or antigen-binding fragments of the invention.

In some embodiments, the polynucleotides of the invention include a polynucleotide encoding a leader sequence. Any leader sequence known in the art may be employed. The polynucleotide encoding the leader sequence may include, a restriction endonuclease cleavage site or a translation initiation site.

Also provided are vectors comprising the polynucleotides of the invention. The vectors can be expression vectors. The expression vector may contain one or more additional sequences such as but not limited to regulatory sequences (e.g., promoter, enhancer), a selection marker, and a polyadenylation signal. Vectors for transforming a wide variety of host cells are well known and include, but are not limited to, plasmids, phagemids, cosmids, baculoviruses, bacmids, bacterial artificial chromosomes (BACs), yeast artificial chromosomes (YACs), as well as other bacterial, yeast and viral vectors.

Recombinant expression vectors within the scope of the description include synthetic, or cDNA-derived nucleic acid fragments that encode at least one recombinant protein which may be operably linked to suitable regulatory elements. Such regulatory elements may include a transcriptional promoter, sequences encoding suitable mRNA ribosomal binding sites, and sequences that control the termination of transcription and translation. Expression vectors, especially mammalian expression vectors, may also include one or more nontranscribed elements such as an origin of replication, a suitable promoter and enhancer linked to the gene to be expressed, other 5' or 3' flanking nontranscribed sequences, 5' or 3' nontranslated sequences (such as necessary ribosome binding sites), a polyadenylation site, splice donor and acceptor sites, or transcriptional termination sequences. An origin of replication that confers the ability to replicate in a host may also be incorporated.

The transcriptional and translational control sequences in expression vectors to be used in transforming vertebrate cells may be provided by viral sources. Exemplary vectors may be constructed as described by Okayama and Berg, 3 Mol. Cell. Biol. 280 (1983).

In some embodiments, the antibody- or antigen-binding fragment-coding sequence is placed under control of a powerful constitutive promoter, such as the promoters for the following genes: hypoxanthine phosphoribosyl transferase (HPRT), adenosine deaminase, pyruvate kinase, beta-actin, human myosin, human hemoglobin, human muscle creatine, and others. In addition, many viral promoters function constitutively in eukaryotic cells and are suitable for use with the described embodiments. Such viral promoters include without limitation, Cytomegalovirus (CMV) immediate early promoter, the early and late promoters of SV40, the Mouse Mammary Tumor Virus (MMTV) promoter, the long terminal repeats (LTRs) of Maloney leukemia virus, Human Immunodeficiency Virus (HIV), Epstein Barr Virus (EBV), Rous Sarcoma Virus (RSV), and other retroviruses, and the thymidine kinase promoter of Herpes Simplex Virus. In one embodiment, the PSMA-specific antibody or antigen-binding fragment thereof coding sequence is placed under control of an inducible promoter such as the metallothionein promoter, tetracycline-inducible promoter, doxycycline-inducible promoter, promoters that contain one or more interferon-stimulated response elements (ISRE) such as protein kinase R 2',5'-oligoadenylate synthetases, Mx genes, ADAR1, and the like.

Vectors described herein may contain one or more Internal Ribosome Entry Site(s) (IRES). Inclusion of an IRES sequence into fusion vectors may be beneficial for enhancing expression of some proteins. In some embodiments the vector system will include one or more polyadenylation sites (e.g., SV40), which may be upstream or downstream of any of the aforementioned nucleic acid sequences. Vector components may be contiguously linked, or arranged in a manner that provides optimal spacing for expressing the gene products (i.e., by the introduction of "spacer" nucleotides between the ORFs), or positioned in another way. Regulatory elements, such as the IRES motif, may also be arranged to provide optimal spacing for expression.

The vectors may comprise selection markers, which are well known in the art. Selection markers include positive and negative selection markers, for example, antibiotic resistance genes (e.g., neomycin resistance gene, a hygromycin resistance gene, a kanamycin resistance gene, a tetracycline resistance gene, a penicillin resistance gene), glutamate synthase genes, HSV-TK, HSV-TK derivatives for ganciclovir selection, or bacterial purine nucleoside phosphorylase gene for 6-methylpurine selection (Gadi et al., 7 *Gene Ther.* 1738-1743 (2000)). A nucleic acid sequence encoding a selection marker or the cloning site may be upstream or downstream of a nucleic acid sequence encoding a polypeptide of interest or cloning site.

The vectors described herein may be used to transform various cells with the genes encoding the described antibodies or antigen-binding fragments. For example, the vectors may be used to generate anti-CD3, anti-PSMA, anti-CD33, anti-TMEFF2, or anti-IL1RAP antibodies or antigen-binding fragment-producing cells. Thus, the invention also provides a host cell comprising the vectors of the invention.

Numerous techniques are known in the art for the introduction of foreign genes into cells and may be used to construct the recombinant cells for purposes of carrying out the described methods, in accordance with the various embodiments described and exemplified herein. The technique used should provide for the stable transfer of the heterologous gene sequence to the host cell, such that the heterologous gene sequence is heritable and expressible by the cell progeny, and so that the necessary development and physiological functions of the recipient cells are not disrupted. Techniques which may be used include but are not limited to chromosome transfer (e.g., cell fusion, chromosome mediated gene transfer, micro cell mediated gene transfer), physical methods (e.g., transfection, spheroplast fusion, microinjection, electroporation, liposome carrier), viral vector transfer (e.g., recombinant DNA viruses, recombinant RNA viruses) and the like (described in Cline, 29 *Pharmac. Ther.* 69-92 (1985)). Calcium phosphate precipitation and polyethylene glycol (PEG)-induced fusion of bacterial protoplasts with mammalian cells may also be used to transform cells.

Cells suitable for use in the expression of the antibodies or antigen-binding fragments described herein are preferably eukaryotic cells, more preferably cells of plant, rodent, or human origin, for example but not limited to NSO, CHO, CHOK1, perC.6, Tk-ts13, BHK, HEK293 cells, COS-7, T98G, CV-1/EBNA, L cells, C127, 3T3, HeLa, NS1, Sp2/0 myeloma cells, and BHK cell lines, among others. In addition, expression of antibodies may be accomplished using hybridoma cells. Methods for producing hybridomas are well established in the art.

Cells transformed with expression vectors of the invention may be selected or screened for recombinant expression of the antibodies or antigen-binding fragments of the invention. Recombinant-positive cells are expanded and screened for subclones exhibiting a desired phenotype, such as high level expression, enhanced growth properties, or the ability to yield proteins with desired biochemical characteristics, for example, due to protein modification or altered post-translational modifications. These phenotypes may be due to inherent properties of a given subclone or to mutation. Mutations may be effected through the use of chemicals, UV-wavelength light, radiation, viruses, insertional mutagens, inhibition of DNA mismatch repair, or a combination of such methods.

Pharmaceutical Compositions/Administration

The invention also provides for pharmaceutical compositions comprising the antibodies of the invention and a pharmaceutically acceptable carrier. For therapeutic use, the antibodies of the invention may be prepared as pharmaceutical compositions containing an effective amount of the antibody as an active ingredient in a pharmaceutically acceptable carrier. "Carrier" refers to a diluent, adjuvant, excipient, or vehicle with which the antibody of the invention is administered. Such vehicles may be liquids, such as water and oils, including those of petroleum, animal, vegetable or synthetic origin, such as peanut oil, soybean oil, mineral oil, sesame oil and the like. For example, 0.4% saline and 0.3% glycine may be used. These solutions are sterile and generally free of particulate matter. They may be sterilized by conventional, well-known sterilization techniques (e.g., filtration). The compositions may contain pharmaceutically acceptable auxiliary substances as required to approximate physiological conditions such as pH adjusting and buffering agents, stabilizing, thickening, lubricating and coloring agents, etc. The concentration of the antibodies of the invention in such pharmaceutical formulation may vary, from less than about 0.5%, usually to at least about 1% to as much as 15 or 20% by weight and may be selected primarily based on required dose, fluid volumes, viscosities, etc., according to the particular mode of administration selected. Suitable vehicles and formulations, inclusive of other human proteins, e.g., human serum albumin, are described, for example, in e.g. Remington: The Science and Practice of Pharmacy, 21st Edition, Troy, D. B. ed., Lippincott Williams and Wilkins, Philadelphia, Pa. 2006, Part 5, Pharmaceutical Manufacturing pp 691-1092, See especially pp. 958-989.

The mode of administration for therapeutic use of the antibodies of the invention may be any suitable route that delivers the antibody to the host, such as parenteral administration, e.g., intradermal, intramuscular, intraperitoneal, intravenous or subcutaneous, pulmonary, transmucosal (oral, intranasal, intravaginal, rectal), using a formulation in a tablet, capsule, solution, powder, gel, particle; and contained in a syringe, an implanted device, osmotic pump, cartridge, micropump; or other means appreciated by the skilled artisan, as well known in the art. Site specific administration may be achieved by for example intratumoral, intrarticular, intrabronchial, intraabdominal, intracapsular, intracartilaginous, intracavitary, intracelial, intracerebellar, intracerebroventricular, intracolic, intracervical, intragastric, intrahepatic, intracardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravascular, intravesical, intralesional, vaginal, rectal, buccal, sublingual, intranasal, or transdermal delivery.

The antibodies of the invention may be administered to a subject by any suitable route, for example parentally by intravenous (i.v.) infusion or bolus injection, intramuscularly or subcutaneously or intraperitoneally. i.v. infusion may be given over for example 15, 30, 60, 90, 120, 180, or 240 minutes, or from 1, 2, 3, 4, 5, 6, 7, 8, 9, 10, 11 or 12 hours.

The dose given to a subject is sufficient to alleviate or at least partially arrest the disease being treated ("therapeutically effective amount") and may be sometimes 0.005 mg to about 100 mg/kg, e.g. about 0.05 mg to about 30 mg/kg or about 5 mg to about 25 mg/kg, or about 4 mg/kg, about 8 mg/kg, about 16 mg/kg or about 24 mg/kg, or for example about 1, 2, 3, 4, 5, 6, 7, 8, 9 or 10 mg/kg, but may even higher, for example about 15, 16, 17, 18, 19, 20, 21, 22, 23, 24, 25, 30, 40, 50, 60, 70, 80, 90 or 100 mg/kg.

A fixed unit dose may also be given, for example, 50, 100, 200, 500 or 1000 mg, or the dose may be based on the patient's surface area, e.g., 500, 400, 300, 250, 200, or 100 mg/m2. Usually between 1 and 8 doses, (e.g., 1, 2, 3, 4, 5, 6, 7 or 8) may be administered to treat the patient, but 9, 10, 11, 12, 13, 14, 15, 16, 17, 18, 19, 20 or more doses may be given.

The administration of the antibodies of the invention may be repeated after one day, two days, three days, four days, five days, six days, one week, two weeks, three weeks, one month, five weeks, six weeks, seven weeks, two months, three months, four months, five months, six months or longer. Repeated courses of treatment are also possible, as is chronic administration. The repeated administration may be at the same dose or at a different dose. For example, the antibodies of the invention described herein may be administered at 8 mg/kg or at 16 mg/kg at weekly interval for 8 weeks, followed by administration at 8 mg/kg or at 16 mg/kg every two weeks for an additional 16 weeks, followed by administration at 8 mg/kg or at 16 mg/kg every four weeks by intravenous infusion.

For example, the antibodies in the methods described herein, may be provided as a daily dosage in an amount of about 0.1-100 mg/kg, such as 0.5, 0.9, 1.0, 1.1, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 45, 50, 60, 70, 80, 90 or 100 mg/kg, per day, on at least one of day 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40, or alternatively, at least one of week 1, 2, 3, 4, 5, 6, 7, 8, 9, 10, 11, 12, 13, 14, 15, 16, 17, 18, 19 or 20 after initiation of treatment, or any combination thereof, using single or divided doses of every 24, 12, 8, 6, 4, or 2 hours, or any combination thereof.

The antibodies in the methods described herein may also be administered prophylactically in order to reduce the risk of developing cancer, delay the onset of the occurrence of an event in cancer progression, and/or reduce the risk of recurrence when a cancer is in remission.

The antibodies provided herein may be lyophilized for storage and reconstituted in a suitable carrier prior to use. This technique has been shown to be effective with conventional protein preparations and well-known lyophilization and reconstitution techniques can be employed.

Methods of Detecting CD3, PSMA, CD33, IL1RAP, TMEFF2 or Target Antigen and CD3

Provided herein are methods of detecting CD3, PSMA, CD33, TMEFF2, or IL1RAP in a sample, comprising obtaining the sample, contacting the sample with the anti-CD3, the anti-PSMA, the anti-CD33, anti-TMEFF2, or the anti-IL1RAP antibody of the invention and detecting the antibody bound to CD3, PSMA, CD33, TMEFF2, or IL1RAP in the sample.

Further provided are methods of detecting CD3 and the second antigen (for example PSMA, CD33, TMEFF2 or IL1RAP) in a sample, comprising obtaining the sample, contacting the sample with the bispecific antibody comprising a first domain that specifically binds CD3 and a second domain that specifically binds a second antigen, and detecting the antibody bound to CD3 and the second antigen in the sample.

In some embodiments described herein, the sample may be derived from urine, blood, serum, plasma, saliva, ascites, circulating cells, circulating tumor cells, cells that are not tissue associated (i.e., free cells), tissues (e.g., surgically resected tumor tissue, biopsies, including fine needle aspiration), histological preparations, and the like.

The antibodies of the invention may be detected using known methods. Exemplary methods include direct labeling of the antibodies using fluorescent or chemiluminescent labels, or radiolabels, or attaching to the antibodies of the invention a moiety which is readily detectable, such as biotin, enzymes or epitope tags. Exemplary labels and moieties are ruthenium, $^{111}$In-DOTA, $^{111}$In-diethylenetriaminepentaacetic acid (DTPA), horseradish peroxidase, alkaline phosphatase and beta-galactosidase, poly-histidine (HIS tag), acridine dyes, cyanine dyes, fluorone dyes, oxazin dyes, phenanthridine dyes, rhodamine dyes and Alexafluor® dyes.

The antibodies provided herein may be used in a variety of assays to detect CD3, PSMA, CD33, IL1RAP, TMEFF2 or CD3 and the second antigenin the sample. Exemplary assays are western blot analysis, radioimmunoassay, surface plasmon resonance, immunoprecipitation, equilibrium dialysis, immunodiffusion, electrochemiluminescence (ECL) immunoassay, immunohistochemistry, fluorescence-activated cell sorting (FACS) or ELISA assay.

Antibody Kits

The invention also provides a kit comprising one or more of the anti-CD3, the anti-PSMA, the anti-CD33, anti-TMEFF2 or the anti-IL1RAP antibodies or the bispecific antibodies comprising a first domain that specifically binds CD3 and a second domain that specifically binds a second antigen of the invention or antigen-binding fragments thereof. The described kits may be used to carry out the methods of using the anti-CD3, the anti-PSMA, the anti-CD33, anti-TMEFF2 or the anti-IL1RAP antibodies or the bispecific antibodies comprising a first domain that specifically binds CD3 and a second domain that specifically binds a second antigen of the invention or other methods known to those skilled in the art. In some embodiments the described kits may include the antibodies or antigen-binding fragments described herein and reagents for use in detecting the presence of CD3 or the second antigen such as PSMA, CD33, IL1RAP, TMEFF2 in a biological sample Accordingly, the described kits may include one or more of the antibodies, or an antigen-binding fragment(s) thereof, described herein and a vessel for containing the antibody or fragment when not in use, instructions for use of the antibody or fragment, the antibody or fragment affixed to a solid support, and/or detectably labeled forms of the antibody or fragment, as described herein.

The invention also provides a kit comprising the herein described antibody that specifically binds PSMA. The invention also provides a kit comprising the herein described antibody specifically binding CD33. The invention also provides a kit comprising the herein described antibody specifically binding IL1RAP. The invention also provides a kit comprising the herein described antibody specifically binding TMEFF2.

The kit may be used for therapeutic uses and as diagnostic kits.

The kit may be used to detect the presence of CD3, PSMA, CD33, IL1RAP, TMEFF2 and/or the second antigen in a biological sample.

In some embodiments, the kit comprises the antibody of the invention described herein and reagents for detecting the antibody. The kit can include one or more other elements including: instructions for use; other reagents, e.g., a label, a therapeutic agent, or an agent useful for chelating, or otherwise coupling, an antibody to a label or therapeutic agent, or a radioprotective composition; devices or other materials for preparing the antibody for administration; pharmaceutically acceptable carriers; and devices or other materials for administration to a subject.

In some embodiments, the kit comprises the antibody of the invention in a container and instructions for use of the kit.

In some embodiments, the antibody in the kit is labeled.

CD3-Specific Antibodies

Described herein are isolated anti-CD3 antibodies. The anti-CD3 antibodies of the invention bind human CD3 and optionally cynomolgus CD3. In some embodiments, the anti-CD3 antibodies of the invention and fragments thereof bind to human and cynomolgus CD3 with affinities within 5-fold of each other. In other words, the difference in antibody binding is less than a multiple of 5. In this case, the anti-CD3 antibody of the invention can be used for both preclinical evaluation of safety, activity and/or pharmacokinetic profile of CD3 in primates and as a drug in humans. Put in other words, the same CD3-specific molecule can be used in preclinical animal studies as well as in clinical studies in humans. This human/cyno cross-reactivity leads to highly comparable results and a much-increased predictive power of the animal studies compared to species-specific surrogate molecules. In some embodiments, the anti-CD3 antibodies and fragments thereof of the invention bind an epitope formed by the CD3e/d subunits. The CD3-specific antibodies may be human, humanized, or chimeric. Also exemplified herein are human antibodies generated in OmniRat (Open Monoclonal Technologies ("OMT"), Palo Alto, Calif., USA, omniab.com).

In some embodiments described herein, the anti-CD3 antibody or fragment thereof has one, two, three, four or five of the following properties:
  a) binds human and *Macaca fascicularis* CD3+T lymphocytes with a calculated EC50 of nM or less and binds *Macaca fascicularis* CD3-expressing HEK cells with a calculated EC50 of 40 nM or less, wherein the difference in calculated EC50 between binding CD3+T lymphocytes and binding *Macaca fascicularis* CD3-expressing HEK cells is less than 5-fold, and wherein the calculated EC50 is measured in a whole cell binding assay at 0° C. using flow cytometry;
  b) binds recombinant CD3d from human (SEQ ID NO:691), or binds recombinant CD3e from human (SEQ ID NO:636), or binds recombinant CD3e from *Macaca fascicularis* (SEQ ID NO:693) with an equilibrium dissociation constant ($K_D$) of 12 nM or less, wherein the $K_D$ is measured using Proteon surface plasmon resonance assay ProteOn XPR36 system at +25° C.;
  c) displays no methionine or tryptophan oxidation, or displays no asparagine deamidation, or displays no asparagine isomerization as detected by peptide mapping analysis;
  d) binds residues 1-6 of CD3e as determined by X-ray crystallography; or
  e) activates T cells or induces CD69 expression to a similar degree as cOKT3 or SP34-2 as determined by fluorescence-activated cell sorting assay.

The anti-CD3 antibodies and fragments thereof of the invention have an in vitro binding affinity ($K_d$) to human T cells expressing human CD3 that is from about 5 nM to about 1000 nM, preferably from about 5 nM to about 50 nM, from about 50 nM to about 100 nM, from about 100 nM to about 200 nM, from about 200 nM to about 300 nM, from about 300 nM to about 400 nM, from about 400 nM to about 500 nM, from about 500 nM to about 600 nM, from about 600 nM to about 700 nM, from about 700 nM to about 800 nM, from about 800 nM to about 900 nM, and from about 900 nM to about 1000 nM, more preferably from about 5 nM to about 300 nM, as determined by flow cytometry.

In some aspects, the anti-CD3 antibodies and fragments thereof of the invention are bivalent antibodies having an in vitro binding affinity ($K_d$) to human T cells expressing human CD3 that is from about 5 nM to about 1000 nM preferably from about 5 nM to about 50 nM, from about 50 nM to about 100 nM, from about 100 nM to about 200 nM, from about 200 nM to about 300 nM, from about 300 nM to about 400 nM, from about 400 nM to about 500 nM, from about 500 nM to about 600 nM, from about 600 nM to about 700 nM, from about 700 nM to about 800 nM, from about 800 nM to about 900 nM, and from about 900 nM to about 1000 nM, more preferably from about 5 nM to about 300 nM, most preferably about 100 nM, as determined by flow cytometry.

In some aspects, the anti-CD3 antibodies and fragments thereof of the invention are monovalent constructs having an in vitro binding affinity ($K_d$) to human T cells expressing human CD3 that is from about 5 nM to about 1000 nM preferably from about 5 nM to about 50 nM, from about 50 nM to about 100 nM, from about 100 nM to about 200 nM, from about 200 nM to about 300 nM, from about 300 nM to about 400 nM, from about 400 nM to about 500 nM, from about 500 nM to about 600 nM, from about 600 nM to about 700 nM, from about 700 nM to about 800 nM, from about 800 nM to about 900 nM, and from about 900 nM to about 1000 nM, more preferably from about 100 nM to about 250 nM, most preferably about 250 nM, as determined by flow cytometry.

In one aspect, the anti-CD3 antibodies and fragments thereof described herein compete with commercial CD3 antibody SP34-2 (BD Biosciences 551916) for binding of CD3, as determined by a competition binding assay using an AlexaFluor 488-conjugated SP34-2 antibody on primary human T cells measured using flow cytometry.

In one aspect, the anti-CD3 antibodies and fragments thereof exhibit no post-translational modification, including no oxidation, no deamidation, and no aspartate isomerization, as determined by peptide mapping.

In one aspect, the anti-CD3 antibodies and fragments thereof are effective in activating T cells and inducing CD69 expression to a similar degree as SP34-2 in human and cynomolgus monkey T cells and cOKT3 in human T cells, as determined by a T cell based assay using flow cytometry.

In one aspect, the anti-CD3 antibodies and fragments thereof described herein have a total enthalpy of unfolding of about 400 kcal/mol or more, about 410 kcal/mol or more, about 420 kcal/mol or more, about 430 kcal/mol or more, about 440 kcal/mol or more, about 45 kcal/mol or more, about 460 kcal/mol or more, about 470 kcal/mol or more, about 480 kcal/mol or more, about 490 kcal/mol or more, about 500 kcal/mol or more, about 510 kcal/mol or more, about 520 kcal/mol or more, about 530 kcal/mol or more, about 540 kcal/mol or more, or about 550 kcal/mol or more. In certain aspects, the anti-CD3 antibodies and fragments thereof of the invention have a total enthalpy of unfolding of about 418 kcal/mol, 545 kcal/mol, about 402 kcal/mol, or about 406 kcal/mol, and the anti-CD3 antibodies are CD3B376 (IgG4 PAA), CD3B450 (IgG4 PAA), CD3B389 (IgG1sigma), and CD3B467 (IgG1sigma) molecules, respectively.

Exemplary such antibodies include CD3B311, CD3B312, CD3B313, CD3B314, CD3B315, CD3B316, CD3B317, CD3B334, CD3B376 CD3B389, CD3B450 and CD3B467, and CD3B376 and CD3B450 engineered into a monovalent format The anti-CD3 antibodies or antigen-binding fragments of the invention can occur in a variety of forms, but will include one or more of the antibody variable domain segments or CDRs shown in Table 7A and engineered variants thereof, for example, those shown or described in Table 9 and Table 10, and the accompanying descriptions thereof.

The invention also provides an anti-CD3 antibody, or an antigen-binding fragment thereof, comprising a heavy chain comprising a HCDR1, a HCDR2, and a HCDR3 of any one of the antibodies described in Table 7B. The invention also provides an anti-CD3 antibody or an antigen-binding fragment thereof, comprising a heavy chain comprising a HCDR1, a HCDR2, and a HCDR3 of any one of the antibodies described in Table 7B and a light chain comprising a LCDR1, a LCDR2, and a LCDR3 of any one of the antibodies described in Table 7B. In some embodiments, the anti-CD3 antibody or an antigen-binding fragment thereof of the invention competes for binding to CD3 with an antibody or antigen-binding fragment thereof comprising a heavy chain comprising a HCDR1, a HCDR2, and a HCDR3 of any one of the antibodies described in Table 7B and a light chain comprising a LCDR1, a LCDR2, and a LCDR3 of any one of the antibodies described in Table 7B.

In some embodiments, the anti-CD3 antibody of an antigen-binding fragment thereof of the invention comprises the HCDR1, the HCDR2 and the HCDR3 contained within a heavy chain variable region (VH) of SEQ ID NOs:651, 652, 653, 654, 655, 687, or 656, wherein the HCDR1, the HCDR2 and the HCDR3 are defined by Chothia, Kabat, or IMGT.

In some embodiments, the anti-CD3 antibody of an antigen-binding fragment thereof of the invention comprises the LCDR1, the LCDR2 and the LCDR3 contained within a light chain variable region (VL) of SEQ ID NOs: 658, 659, 694, 660, 688, or 661, wherein the LCDR1, the LCDR2 and the LCDR3 are defined by Chothia, Kabat, or IMGT.

In some embodiments, the anti-CD3 antibody of an antigen-binding fragment thereof of the invention comprises
   the HCDR1 of SEQ ID NOs: 662, 665, or 666;
   the HCDR2 of SEQ ID NOs: 663, 689, or 695; and
   the HCDR3 of SEQ ID NOs: 664.

In some embodiments, the anti-CD3 antibody of an antigen-binding fragment thereof of the invention comprises
   the LCDR1 of SEQ ID NOs: 773, 710, 674 or 671;
   the LCDR2 of SEQ ID NOs: 669 or 673; and
   the LCDR3 of SEQ ID NOs: 670.

In some embodiments, the anti-CD3 antibody of an antigen-binding fragment thereof of the invention comprises
   the HCDR1 of SEQ ID NOs: 662, 665, or 666;
   the HCDR2 of SEQ ID NOs: 663, 689, or 695;
   the HCDR3 of SEQ ID NOs: 664;
   the LCDR1 of SEQ ID NOs: 773, 710, 674 or 671;
   the LCDR2 of SEQ ID NOs: 669 or 673; and
   the LCDR3 of SEQ ID NOs: 670.

In some embodiments, the anti-CD3 antibody of an antigen-binding fragment thereof of the invention comprises the HCDR1, the HCDR2 and the HCDR3 of
   SEQ ID NOs: 662, 663, and 664, respectively;
   SEQ ID NOs: 662, 695, and 664, respectively;
   SEQ ID NOs: 665, 663, and 664, respectively;
   SEQ ID NOs: 665, 695, and 664, respectively;
   SEQ ID NOs: 662, 689, and 664, respectively;
   SEQ ID NOs: 666, 663, and 664, respectively;
   SEQ ID NOs: 666, 695, and 664, respectively
   SEQ ID NOs: 665, 689, and 664, respectively; or
   SEQ ID NOs: 666, 689, 664, respectively.

In some embodiments, the anti-CD3 antibody of an antigen-binding fragment thereof of the invention comprises the LCDR1, the LCDR2 and the LCDR3 of
   SEQ ID NOs: 773, 669, and 670, respectively;
   SEQ ID NOs: 773, 673, and 670, respectively;
   SEQ ID NOs: 710, 673, and 670, respectively;
   SEQ ID NOs: 674, 673, and 670, respectively;
   SEQ ID NOs: 671, 673, and 690, respectively;
   SEQ ID NOs: 773, 673, and 690, respectively;
   SEQ ID NOs: 671, 669, and 670, respectively; or
   SEQ ID NOs: 776, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 663, 664, 773, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 663, 664, 773, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 663, 664, 671, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 663, 664, 671, 673, and 690, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 695, 664, 773, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 695, 664, 773, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 695, 664, 671, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 695, 664, 671, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 665, 663, 664, 773, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 665, 663, 664, 773, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 665, 663, 664, 671, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 665, 663, 664, 671, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 665, 695, 664, 773, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 665, 695, 664, 773, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 665, 695, 664, 776, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 665, 695, 664, 776, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 666, 663, 664, 773, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 666, 663, 664, 773, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 666, 663, 664, 776, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 666, 663, 664, 671, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 666, 695, 664, 773, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 666, 695, 664, 773, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 666, 695, 664, 671, 669, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 666, 695, 664, 671, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 689, 664, 671, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 663, 664, 710, 673, and 670, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 663, 664, 671, 673, and 690, respectively.

In some embodiments, the anti-CD3 antibody of an antigen-binding fragment thereof of the invention comprises the HCDR1, HCDR2, HCDR3, LCDR1, LCDR2, and LCDR3 of SEQ ID NOs: 662, 663, 664, 773, 673, and 690, respectively.

In some embodiments, the anti-CD3 antibody of an antigen-binding fragment thereof of the invention comprises a heavy chain (HC) sequence of SEQ ID NO: 709, 640, 641, 642, 643, 675, or 644 and/or a light chain (LC) sequence of SEQ ID NO: 645, 716, 649, 676, 677, or 650. In some embodiments, the anti-CD3 antibody of an antigen-binding fragment thereof of the invention comprises a HC having a polypeptide sequence at least 85%, preferably 90%, more preferably 95% or more, such as 95%, 96%, 97%, 98%, or 99% identical to SEQ ID NO:709, 640, 641, 642, 643, 675, or 644, and a LC having a polypeptide sequence at least 85%, preferably 90%, more preferably 95% or more, such as 95%, 96%, 97%, 98%, or 99% identical to SEQ ID NO:645, 716, 649, 676, 677, or 650. In some embodiments, the anti-CD3 antibody of an antigen-binding fragment thereof of the invention comprises a HC having a polypeptide sequence at least 85%, preferably 90%, more preferably 95% or more, such as 95%, 96%, 97%, 98%, or 99% identical to SEQ ID NO: 709, 640, 641, 642, 643, 675, or 644, and a LC having a polypeptide sequence at least 85%, preferably 90%, more preferably 95% or more, such as 95%, 96%, 97%, 98%, or 99% identical to SEQ ID NO:645, 716, 649, 676, 677 or 650, wherein the variation in sequence does not occur in a CDR region.

In some embodiments, the anti-CD3 antibody of an antigen-binding fragment thereof of the invention comprises a heavy chain variable region (VH) sequence of SEQ ID NO:651, 652, 657, 653, 654, 655, 687, or 656 and/or a light chain variable region (VL) sequence of SEQ ID NO:658, 659, 694, 660, 688, 678, or 661. In some embodiments, the anti-CD3 antibody of an antigen-binding fragment thereof of the invention comprises a VH having a polypeptide sequence at least 85%, preferably 90%, more preferably 95% or more, such as 95%, 96%, 97%, 98%, or 99% identical to SEQ ID NO: 651, 652, 657, 653, 654, 655, 687, or 656, and a VL having a polypeptide sequence at least 85%, preferably 90%, more preferably 95% or more, such as 95%, 96%, 97%, 98%, or 99% identical to SEQ ID NOS 658, 659, 694, 660, 688, 678, or 661. In some embodiments, the anti-CD3 antibody of an antigen-binding fragment thereof of the invention comprises a VH having a polypeptide sequence at least 85%, preferably 90%, more preferably 95% or more, such as 95%, 96%, 97%, 98%, or 99% identical to SEQ ID NO: 651, 652, 657, 653, 654, 655, 687, or 656, and a VL having a polypeptide sequence at least 85%, preferably 90%, more preferably 95% or more, such as 95%, 96%, 97%, 98%, or 99% identical to SEQ ID NO:658, 659, 694, 660, 688, 678, or 661, wherein the variation in sequence does not occur in a CDR region.

PSMA-Specific Antibodies

The antibodies and fragments thereof that bind to PSMA bind to the chimpanzee target antigen. In one embodiment, the antibodies and fragments thereof bind to the human and macaque PSMA target antigens with affinities within 5-fold of each other. In other words, the difference in antibody binding is less than a multiple of 5. In this case, the identical antibody molecule can be used both for preclinical evaluation of safety, activity and/or pharmacokinetic profile of PSMA in primates and as a drug in humans. Put in other words, the same PSMA-specific molecule can be used in preclinical animal studies as well as in clinical studies in humans. This leads to highly comparable results and a much-increased predictive power of the animal studies compared to species-specific surrogate molecules. Since the PSMA domain is cross-species specific, i.e. reactive with the human and macaque antigens, the antibody or fragments thereof of the invention can be used both for preclinical evaluation of safety, activity and/or pharmacokinetic profile of these binding domains in primates and—in the identical form—as drug in humans.

The present invention also provides for multispecific antibodies that specifically bind to PSMA. According to the invention, a bispecific, i.e. bifunctional, antibody can be used to engage two different therapeutic targets or perform two distinct functions. Such antibodies can be used for example to recruit an immune effector cell, e.g. T- or NK-cell, towards a particular target cell. Various antibody-fragment based molecules are known and under investigation, for example for cancer therapy.

The present invention also provides for a PSMA×"effector antigen" bispecific antibody. In one embodiment, the effector antigen of the PSMA×"effector antigen" bispecific antibody is CD3. It has been found in the present invention that it is possible to generate a PSMA×CD3 bispecific antibody wherein the identical molecule can be used in preclinical animal testing, as well as clinical studies and even in therapy in human. This is due to the identification of the PSMA×CD3 bispecific antibody, which, in addition to binding to human PSMA and human CD3, respectively, also binds to the homologs of antigens of chimpanzee and macaques. The PSMA×CD3 bispecific antibody of the invention can be used as a therapeutic agent against various diseases, including, but not limited to, cancer. In view of the above, the need to construct a surrogate target PSMA×CD3 bispecific antibody for testing in a phylogenetically distant (from humans) species disappears. As a result, the identical molecule can be used in animal preclinical testing as is intended to be administered to humans in clinical testing as well as following market approval and therapeutic drug administration.

In some embodiments described herein, the isolated antibody or antibody fragment thereof specifically binding PSMA has one, two, three, four or five of the following properties:

a. binds *Pan troglodytes* PSMA extracellular domain (ECD) with an equilibrium dissociation constant ($K_D$) of 25 nM or less, wherein the $K_D$ is measured using ProteOn XPR36 system at +25° C., b. binds LNCaP cells with a calculated EC50 of 20 nM or less and binds *Macaca fascicularis* PSMA-expressing HEK cells with a calculated EC50 of 40 nM or less, wherein the difference in calculated EC50 between binding LNCaP cells and binding *Macaca fascicularis* PSMA-expressing HEK cells is less than 5-fold, and wherein the calculated EC50 is measured in a whole cell binding assay at 0° C. using flow cytometry, c. binds recombinant PSMA ECD from human (SEQ ID NO:55), *Pan troglodytes* (SEQ ID NO:52) and *Macaca fascicularis* (SEQ ID NO:53) with an equilibrium dissociation constant ($K_D$) of 12 nM or less, wherein the $K_D$ is measured using Proteon surface plasmon resonance assay ProteOn XPR36 system at +25° C.;

d. displays T-cell mediated killing of LNCaP cells, C42 cells, human PSMA-expressing HEK cells or *Macaca fascicularis* PSMA-expressing HEK cells when paired in a bispecific antibody with anti-CD3 antibody, wherein the T-cell mediated killing is measured by Chromium-51 or by caspase 3/7 activation assay, or e. recognizes a conformational epitope wherein the epitope is comprised of residues I138, F235, P237, G238, D244, Y299, Y300, Q303, K304, E307, and K324-P326 of human PSMA (SEQ ID NO:51)

Exemplary such antibodies or fragments thereof are PSMA antibodies PSMB119, PSMB120, PSMB121, PSMB122, PSMB123, PSMB87, PSMB126, PSMB127, PSMB128, PSMB129, PSMB130, PSMB120, PSMB121, PSMB122, PSMB123, PSMB127, PSMB128, PSMB130, PSMB344, PSMB345, PSMB346, PSMB347, PSMB349, PSMB358, PSMB359, PSMB360, PSMB361, PSMB362, PSMB363, and PSMB365 described herein.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:56, 57, 58, 59, 60, and 61, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:62, 63, 64, 65, 60, and 66, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:67, 68, 69, 70, 71, and 72, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:73, 74, 75, 76, 60, and 61, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:78, 79, 80, 81, 82, and 83, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:84, 85, 86, 87, 60, and 88, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:89, 90, 91, 92, 93, and 94, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:95, 96, 97, 65, 60, and 66, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:84, 98, 99, 100, 82, and 101, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:89, 90, 102, 103, 104, and 105, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs:89, 90, 106, 103, 104, and 105, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 107, 108, 109, 76, 60, and 88, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 1, 80, 81, 82, and 83, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 1, 80, 81, 82, and 83, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 1, 80, 4, 82, and 686, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 1, 80, 81, 792, and 686, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 2, 80, 81, 82, and 83, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 3, 80, 81, 82, and 5, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 3, 80, 81, 82, and 83, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 3, 80, 4, 82, and 686, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 3, 80, 81, 792, and 686, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 2, 81, 81, 82, and 5, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 2, 80, 4, 792, and 686, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 2, 80, 4, 792, and 686, respectively.

In some embodiments of the invention described herein, the antibody specifically binding PSMA of the invention comprises the HCDR1, the HCDR2, the HCDR3, the LCDR1, the LCDR2 and the LCDR3 of SEQ ID NOs: 78, 683, 80, 81, 792, and 686, respectively.

In some embodiments of the invention described herein, the antibody specifically binding PSMA of the invention comprises a heavy chain variable region (VH) of SEQ ID NOs: 6, 7, 8, 110, 112, 114, 116, 118, 120, 121, 123, 125, 126, 128, 130, or 681. In some embodiments of the invention described herein, the antibody specifically binding PSMA of the invention comprises a light chain variable region (VL) of SEQ ID NOs: 9, 111, 113, 115, 117, 119, 122, 124, 127, 129, 131, or 682.

In some embodiments of the invention described herein, the antibody specifically binding PSMA of the invention comprises a heavy chain sequence of SEQ ID NOs: 12, 13, 132, 134, 136, 138, 140, 141, 143, 145, 146, 148, 150, 151, or 679.

In some embodiments of the invention described herein, the antibody specifically binding PSMA of the invention comprises a light chain sequence of SEQ ID NOs: 14, 15, 75, 133, 135, 137, 139, 142, 144, 147, 149 or 680.

CD33-Specific Antibodies

The CD33-specific antibodies of the invention possess one or more desirable functional properties, including but not limited to high-affinity binding to CD33 and/or CD3, high specificity to CD33 and/or CD3, and the ability to treat or prevent cancer when administered alone or in combination with other anti-cancer therapies.

In certain embodiments, the isolated monoclonal antibodies or antigen-binding fragments thereof bind the C2 domain of CD33. In certain embodiments, the isolated monoclonal antibodies or antigen-binding fragments thereof bind the V domain of CD33. The full length human CD33 is provided by Uniprot P20138 (SEQ ID NO:244).

As used herein, an antibody that "specifically binds to CD33" refers to an antibody that binds to a CD33, preferably a human CD33, preferably the C2 domain of CD33, with a KD of $1 \times 10^{-7}$ M or less, preferably $1 \times 10^{-8}$ M or less, more preferably $5 \times 10^{-9}$ M or less, $1 \times 10^{-9}$ M or less, $5 \times 10^{-1}$ M or less, or $1 \times 10^{-10}$ M or less.

The antibodies or antigen-binding fragments described herein can occur in a variety of forms, but will include one or more of the antibody CDRs shown in Table 39 and 40.

Described herein are recombinant antibodies and antigen-binding fragments that specifically bind to CD33. In some embodiments, the CD33-specific antibodies or antigen-binding fragments are human IgG, or derivatives thereof. While the CD33-specific antibodies or antigen-binding fragments exemplified herein are human, the antibodies or antigen-binding fragments exemplified may be chimerized.

In some embodiments are provided an CD33-specific antibody, or an antigen-binding fragment thereof, comprising a heavy chain comprising a CDR1, a CDR2, and a CDR3 of any one of the antibodies described in Table 39. In some embodiments are provided an CD33-specific antibody, or an antigen-binding fragment thereof, comprising a heavy chain comprising a CDR1, a CDR2, and a CDR3 of any one of the antibodies described in Table 39 and a light chain comprising a CDR1, a CDR2, and a CDR3 of any one of the antibodies described in Table 40.

In some embodiments are provided a CD33-specific antibody, or antigen-binding fragment thereof, comprising a heavy chain variable region shown in Table 38. In some embodiments are provided a CD33-specific antibody, or antigen-binding fragment thereof, comprising a light chain variable region shown in Table 38.

The heavy chain variable domain and light chain variable domain of antibodies discussed in this section and shown in Table 38 are suitable for inclusion in bispecific constructs. For example, in some embodiments of the CD33 bispecific antibodies, the effector arm is a CD3 arm. In some embodiments of the CD33×CD3 bispecific antibody, the CD3 arm comprises the HCDR1, the HCDR2, the HCDR3, the LCDR1, the LCDR2, and the LCDR3 of SEQ ID NOs:662, 663, 664, 671, 673, and 670, respectively. In some embodiments of the CD33×CD3 bispecific antibody, the CD3 arm comprises the VH and VL of SEQ ID NOs: 652 and 661, respectively. In some embodiments of the CD33×CD3 bispecific antibody, the CD3 arm comprises the HC and LC of SEQ ID NOs: 640 and 676, respectively.

In some embodiments of the CD33×CD3 bispecific antibody, the CD3 arm comprises the HCDR1, the HCDR2, the HCDR3, the LCDR1, the LCDR2, and the LCDR3 of SEQ ID NOs:662, 663, 664, 773, 673, and 670, respectively. In some embodiments of the CD33×CD3 bispecific antibody, the CD3 arm comprises the VH and VL of SEQ ID NOs:657 and 678, respectively. In some embodiments of the CD33× CD3 bispecific antibody, the CD3 arm comprises the HC and LC of SEQ ID NOs:675 and 677, respectively.

In certain embodiments, the anti-CD33 antibody or antigen-binding fragment thereof comprises a heavy chain variable region having a polypeptide sequence at least 95% identical to SEQ ID NO:267, 260, 275, 270, 262, 258, 257, 281, 292, 291, 261, 269, 280, 259, 263, 264, 265, 266, 272, 277, 279, 284, or 285, or a light chain variable region having a polypeptide sequence at least 95% identical to SEQ ID NO:287, 314, 309, 301, 298, 297, 290, 332, 331, 302, 310, 320, 300, 304, 305, 306, 307, 317, 319, 324, or 325; and the anti-CD3 antibody or antigen-binding fragment thereof comprises a heavy chain variable region having a polypeptide sequence at least 95% identical to SEQ ID NO:257 or 258, or a light chain variable region having a polypeptide sequence at least 95% identical to SEQ ID NO:298 or 299.

IL1RAP-Specific Antibodies

As used herein, the terms "interleukin-1 receptor accessory protein", "IL1RAP" and "IL1-RAP" specifically include the human IL1RAP protein (SEQ ID NO:576), for example as described in GenBank Accession No. AAB84059, NCBI Reference Sequence: NP_002173.1 and UniProtKB/Swiss-Prot Accession No. Q9NPH3-1 (see also Huang et al., 1997, Proc. Natl. Acad. Sci. USA. 94 (24), 12829-12832). IL1RAP is also known in the scientific literature as IL1 R3, C3orf13, FLJ37788, IL-1 RAcP and EG3556.

The antibodies or antigen-binding fragments described herein can occur in a variety of forms, but will include one or more of the antibody CDRs shown in Table 29.

Described herein are recombinant antibodies and antigen-binding fragments that specifically bind to IL1RAP. In some embodiments, the IL1RAP-specific antibodies or antigen-binding fragments are human IgG, or derivatives thereof. While the IL1RAP-specific antibodies or antigen-binding fragments exemplified herein are human, the antibodies or antigen-binding fragments exemplified may be chimerized.

In some embodiments are provided an IL1RAP-specific antibody, or an antigen-binding fragment thereof, comprising a heavy chain comprising a CDR1, a CDR2, and a CDR3 of any one of the antibodies described in Table 29. In some embodiments are provided an IL1RAP-specific antibody, or an antigen-binding fragment thereof, comprising a heavy chain comprising a CDR1, a CDR2, and a CDR3 of any one of the antibodies described in Table 29 and a light chain comprising a CDR1, a CDR2, and a CDR3 of any one of the antibodies described in Table 29.

In some embodiments are provided a IL1RAP-specific antibody, or antigen-binding fragment thereof, comprising a heavy chain variable region of any one of the antibodies shown in Table 30. In some embodiments are provided a IL1RAP-specific antibody, or antigen-binding fragment thereof, comprising a light chain variable region of any one of the antibodies shown in Table 30. In some embodiments are provided a IL1RAP-specific antibody, or antigen-binding fragment thereof, comprising a heavy chain variable region and a light chain variable region of any one of the antibodies shown in Table 30.

The heavy chain variable domain and light chain variable domain of antibodies discussed in this section and shown in Table 30 are suitable for inclusion in bispecific constructs in which the targeting arm is an anti-IL1RAP arm. For example, in some embodiments of the IL1RAP bispecific antibodies, the effector arm is a CD3 arm. In some embodiments of the IL1RAP×CD3 bispecific antibody, the CD3 arm comprises the HCDR1, the HCDR2, the HCDR3, the LCDR1, the LCDR2, and the LCDR3 of SEQ ID NOs:662, 663, 664, 671, 673, and 670, respectively. In some embodiments of the IL1RAP×CD3 bispecific antibody, the CD3 arm comprises the VH and VL of SEQ ID NOs: 652 and 661, respectively. In some embodiments of the IL1RAP×CD3 bispecific antibody, the CD3 arm comprises the HC and LC of SEQ ID NOs: 640 and 676, respectively.

In some embodiments of the IL1RAP×CD3 bispecific antibody, the CD3 arm comprises the HCDR1, the HCDR2, the HCDR3, the LCDR1, the LCDR2, and the LCDR3 of SEQ ID NOs:662, 663, 664, 773, 673, and 670, respectively.

In some embodiments of the IL1RAP×CD3 bispecific antibody, the CD3 arm comprises the VH and VL of SEQ ID NOs:657 and 678, respectively. In some embodiments of the IL1RAP×CD3 bispecific antibody, the CD3 arm comprises the HC and LC of SEQ ID NOs:675 and 677, respectively.

TMEFF2-Specific Antibodies

The invention provides an isolated anti-TMEFF2 antibody or an antigen binding fragment thereof that binds to a membrane proximal region of SEQ ID NO: 629 of TMEFF2. The anti-TMEFF2 antibodies of the invention binding the membrane proximal region of TMEFF2 are not internalized by cells. While wishing not to be bound by any particular theory, it can be expected that non-internalizing anti-TMEFF2 antibodies have improved oncogenic effect mediated by antibody effector functions resulting from lack of internalization and degradation of TMEFF2 when compared to internalizing anti-TMEFF2 antibodies.

"Binds to a membrane proximal region" means that 90% of antibody epitope residues identified using hydrogen/deuterium exchange (H/D exchange) reside within the membrane proximal region of TMEFF2. The epitope residues are those which are protected by the test antibody by at least 5% difference in deuteration levels through H/D exchange. Exemplary such antibodies are TMEB675, TMEB570, TMEB674, TMEB565, TMEB762 and TMEB757 as described herein.

In some embodiments, the isolated anti-TMEFF2 antibody or the antigen binding fragment thereof binds within residues HGKCEHSINMQEPSC (SEQ ID NO: 592) or DAGYTGQHCEKKDYSVL (SEQ ID NO: 600) to the membrane proximal region of TMEFF2. An exemplary anti-TMEFF2 antibody binding within residues HGKCEHSINMQEPSC (SEQ ID NO: 592) is TMEB570. An exemplary anti-TMEFF2 antibody binding within residues DAGYTGQHCEKKDYSVL (SEQ ID NO: 600) is TMEB675. TNEB675 variants TMEB762 and TMEB757 are also expected to bind the membrane proximal region of TMEFF2 within residues DAGYTGQHCEKKDYSVL (SEQ ID NO: 600).

In an H/D exchange assay, recombinantly expressed TMEFF2 ECD is incubated in the presence or absence of the antibody in deuterated water for predetermined times resulting in deuterium incorporation at exchangeable hydrogen atoms which are unprotected by the antibody, followed by protease digestion of the protein and analyses of the peptide fragments using LC-MS. H/D exchange assay can be performed using known protocols. An exemplary protocol is described in Example 5.

The invention also provides an isolated anti-TMEFF2 antibody or an antigen binding fragment thereof, wherein the antibody or the antigen binding fragment thereof competes for binding to the membrane proximal region of TMEFF2 with a reference antibody comprising a heavy chain variable region (VH) of SEQ ID NO: 25 and a light chain variable region (VL) of SEQ ID NO: 28, the VH of SEQ ID NO: 589 and the VL of SEQ ID NO: 29, the VH of SEQ ID NO: 27 and the VL of SEQ ID NO: 30, the VH of SEQ ID NO: 589 and the VL of SEQ ID NO: 31, the VH of SEQ ID NO: 604 and the VL of SEQ ID NO: 607, or the VH of SEQ ID NO: 612 and the VL of SEQ ID NO: 613.

Competition for binding of a test antibody to the membrane proximal region of TMEFF2 with the reference antibody may be assayed in vitro using well known methods. For example, binding of MSD Sulfo-Tag™ NHS-ester-labeled test antibody to the membrane proximal region of TMEFF2 in the presence of an unlabeled reference antibody may be assessed by ELISA, or Biacore analyses or flow cytometry may be used to demonstrate competition. The test antibody competes for binding to TMEFF2 with the reference antibody when the test antibody inhibits binding of the reference antibody to the membrane proximal region of TMEFF2 by 85% or more, for example 90% or more, or 95% or more.

The invention also provides an isolated anti-TMEFF2 antibody or an antigen binding fragment thereof comprising a heavy chain complementarity determining region 1 (HCDR1), a HCDR2, a HCDR3, a light chain complementarity determining region 1 (LCDR1), a LCDR2 and a LCDR3 of
SEQ ID NOs: 582, 584, 587, 18, 588 and 22, respectively;
SEQ ID NOs: 583, 585, 16, 19, 21, and 23, respectively;
SEQ ID NOs: 582, 586, 17, 18, 588 and 24, respectively;
SEQ ID NOs: 583, 585, 16, 18, 588 and 22, respectively;
or
SEQ ID NOs: 582, 584, 587, 18, 588 and 603, respectively.

In some embodiments, the isolated anti-TMEFF2 antibody or the antigen binding fragment thereof of the invention binds to the membrane proximal region of TMEFF2 with an equilibrium dissociation constant ($K_D$) of about $0.4 \times 10^{-9}$ M or less, wherein the $K_D$ is measured using surface plasmon resonance in acetate buffer at pH 4.5-5.0 at room temperature.

In some embodiments, the isolated anti-TMEFF2 antibody or the antigen binding fragment thereof binds to the membrane proximal region of TMEFF2 with the $K_D$ of between about $0.1 \times 10^{-10}$ M and about $0.4 \times 10^{-9}$ M.

The affinity of an antibody to the membrane proximal region of TMEFF2 may be determined experimentally using any suitable method. An exemplary method utilizes ProteOn XPR36, Biacore 3000 or KinExA instrumentation, ELISA or competitive binding assays known to those skilled in the art. The measured affinity of an antibody to TMEFF2 may vary if measured under different conditions (e.g., osmolarity, pH). Thus, measurements of affinity and other binding parameters (e.g., $K_D$, $K_{on}$, and Koff) are typically made with standardized conditions and a standardized buffer, such as the buffer described herein. Skilled in the art will appreciate that the internal error for affinity measurements for example using Biacore 3000 or ProteOn (measured as standard deviation, SD) can typically be within 5-33% for measurements within the typical limits of detection. Therefore, the term "about" when referring to a $K_D$ value reflects the typical standard deviation in the assay. For example, the typical SD for a $K_D$ of $1 \times 10^{-9}$ M is up to $\pm 0.33 \times 10^{-9}$ M.

The invention also provides an isolated anti-TMEFF2 antibody or an antigen binding fragment thereof that binds to the membrane proximal region of TMEFF2, comprising a heavy chain variable region (VH) framework derived from VH3_3-23 (SEQ ID NO: 53) or VH1_1-69 (SEQ ID NO: 54).

The invention also provides an isolated anti-TMEFF2 antibody or an antigen binding fragment thereof that binds to the membrane proximal region of TMEFF2, comprising a light chain variable region (VL) framework derived from VKI_L11 (SEQ ID NO: 55) or VKIIII_A27 (SEQ ID NO: 591).

The invention also provides an isolated anti-TMEFF2 antibody or an antigen binding fragment thereof that binds to the membrane proximal region of TMEFF2, comprising a VH framework and a VL framework derived from VH3_3-23 of SEQ ID NO: 53 and VKI_L11 of SEQ ID NO: 55, respectively.

The invention also provides an isolated anti-TMEFF2 antibody or an antigen binding fragment thereof that binds to the membrane proximal region of TMEFF2, comprising a VH framework and a VL framework derived from VH1_1-69 of SEQ ID NO: 54 and VKIII_A27 of SEQ ID NO: 591, respectively.

The invention also provides an isolated anti-TMEFF2 antibody or an antigen binding fragment thereof that binds to the membrane proximal region of TMEFF2, comprising a VH framework and a VL framework derived from VH1_1-69 of SEQ ID NO: 54 and VKI_L11 of SEQ ID NO: 55, respectively.

Antibodies comprising heavy or light chain variable regions "derived from" a particular framework or germline sequence refer to antibodies obtained from a system that uses human germline immunoglobulin genes, such as from transgenic mice, rats or chicken or from phage display libraries as discussed herein. An antibody containing particular framework derived from germline sequence may contain amino acid differences as compared to the sequence it was derived from, due to, for example, naturally-occurring somatic mutations or intentional substitutions.

The invention also provides an isolated anti-TMEFF2 antibody or an antigen binding fragment thereof, comprising a HCDR1, a HCDR2, a HCDR3, a LCDR1, a LCDR2 and a LCDR3 of SEQ ID NOs: 582, 584, 587, 18, 588 and 22, respectively.

In some embodiments, the isolated anti-TMEFF2 antibody or the antigen-binding fragment thereof comprises a VH of SEQ ID NO: 25 and a VL of SEQ ID NO: 28.

In some embodiments, the VH is encoded by a polynucleotide of SEQ ID NO: 39 and the VL is encoded by a polynucleotide of SEQ ID NO: 42.

In some embodiments, the isolated anti-TMEFF2 antibody or the antigen binding fragment thereof comprises a HC of SEQ ID NO: 32 and a LC of SEQ ID NO: 35.

In some embodiments, the HC is encoded by a polynucleotide of SEQ ID NO: 46 and the VL is encoded by a polynucleotide of SEQ ID NO: 49.

The invention also provides an isolated anti-TMEFF2 antibody or an antigen binding fragment thereof comprising a HCDR1, a HCDR2, a HCDR3, a LCDR1, a LCDR2 and a LCDR3 of SEQ ID NOs: 583, 585, 16, 19, 21 and 23, respectively.

In some embodiments, the isolated anti-TMEFF2 antibody or the antigen-binding fragment thereof comprises a VH of SEQ ID NO: 589 and a VL of SEQ ID NO: 29.

In some embodiments, the VH is encoded by a polynucleotide of SEQ ID NO: 40 and the VL is encoded by a polynucleotide of SEQ ID NO: 43.

In some embodiments, the isolated anti-TMEFF2 antibody or the antigen binding fragment thereof comprises a HC of SEQ ID NO: 33 and a LC of SEQ ID NO: 36.

In some embodiments, the HC is encoded by a polynucleotide of SEQ ID NO: 47 and the LC is encoded by a polynucleotide of SEQ ID NO: 50.

The invention also provides an isolated anti-TMEFF2 antibody or an antigen binding fragment thereof comprising a HCDR1, a HCDR2, a HCDR3, a LCDR1, a LCDR2 and a LCDR3 of SEQ ID NOs: 582, 586, 17, 18, 588 and 24, respectively.

In some embodiments, the isolated anti-TMEFF2 antibody or the antigen binding fragment thereof comprises a VH of SEQ ID NO: 27 and a VL of SEQ ID NO: 30.

In some embodiments, the VH is encoded by a polynucleotide of SEQ ID NO: 41 and the VL is encoded by a polynucleotide of SEQ ID NO: 44.

In some embodiments, the isolated anti-TMEFF2 antibody or the antigen binding fragment thereof comprises a HC of SEQ ID NO: 34 and a LC of SEQ ID NO: 37.

In some embodiments, the HC is encoded by a polynucleotide of SEQ ID NO: 48 and the LC is encoded by a polynucleotide of SEQ ID NO: 51.

The invention also provides an isolated anti-TMEFF2 antibody or an antigen binding fragment thereof comprising a HCDR1, a HCDR2, a HCDR3, a LCDR1, a LCDR2 and a LCDR3 of SEQ ID NOs: 583, 585, 16, 18, 588 and 22, respectively.

In some embodiments, the isolated anti-TMEFF2 antibody or the antigen binding fragment thereof comprises a VH of SEQ ID NO: 589 and a VL of SEQ ID NO: 31.

In some embodiments, the VH is encoded by a polynucleotide of SEQ ID NO: 40 and the VL is encoded by a polynucleotide of SEQ ID NO: 45.

In some embodiments, the isolated anti-TMEFF2 antibody or the antigen binding fragment thereof comprises a HC of SEQ ID NO: 33 and a LC of SEQ ID NO: 38.

In some embodiments, the HC is encoded by a polynucleotide of SEQ ID NO: 47 and the LC is encoded by a polynucleotide of SEQ ID NO: 590.

The invention also provides an isolated anti-TMEFF2 antibody or an antigen binding fragment thereof comprising a HCDR1, a HCDR2, a HCDR3, a LCDR1, a LCDR2 and a LCDR3 of SEQ ID NOs: 582, 584, 587, 18, 588 and 603, respectively.

In some embodiments, the isolated anti-TMEFF2 antibody or the antigen-binding fragment thereof comprises a VH of SEQ ID NO: 604 and a VL of SEQ ID NO: 607.

In some embodiments, the VH is encoded by a polynucleotide of SEQ ID NO: 618 and the VL is encoded by a polynucleotide of SEQ ID NO: 619.

In some embodiments, the isolated anti-TMEFF2 antibody or the antigen binding fragment thereof comprises a HC of SEQ ID NO: 614 and a LC of SEQ ID NO: 615.

In some embodiments, the HC is encoded by a polynucleotide of SEQ ID NO: 620 and the LC is encoded by a polynucleotide of SEQ ID NO: 621.

The invention also provides an isolated anti-TMEFF2 antibody or an antigen binding fragment thereof comprising a HCDR1, a HCDR2, a HCDR3, a LCDR1, a LCDR2 and a LCDR3 of SEQ ID NOs: 582, 584, 587, 18, 588 and 603, respectively.

In some embodiments, the isolated anti-TMEFF2 antibody or the antigen binding fragment thereof comprises a VH of SEQ ID NO: 612 and a VL of SEQ ID NO: 613.

In some embodiments, the VH is encoded by a polynucleotide of SEQ ID NO: 622 and the VL is encoded by a polynucleotide of SEQ ID NO: 623.

In some embodiments, the isolated anti-TMEFF2 antibody or the antigen binding fragment thereof comprises a HC of SEQ ID NO: 616 and a LC of SEQ ID NO: 617.

In some embodiments, the HC is encoded by a polynucleotide of SEQ ID NO: 624 and the LC is encoded by a polynucleotide of SEQ ID NO: 625.

In some embodiments, the isolated anti-TMEFF2 antibody or the antigen binding fragment thereof is a multispecific antibody.

In some embodiments, the isolated anti-TMEFF2 antibody or the antigen binding fragment thereof is a bispecific antibody.

In some embodiments, the isolated anti-TMEFF2 bispecific antibody or the antigen binding fragment thereof binds a T cell antigen.

In some embodiments, the isolated anti-TMEFF2 bispecific antibody or the antigen binding fragment thereof binds CD3.

In some embodiments, the isolated anti-TMEFF2 bispecific antibody or the antigen-binding fragment thereof binds CD3 epsilon.

The VH, the VL, the HCDR, the LCDR, the HC and the LC sequences of exemplary anti-TMEFF2 antibodies of the invention are shown in Tables 60-67.

Although the embodiments illustrated in the Examples comprise pairs of variable domains, one from a heavy chain and one from a light chain, a skilled artisan will recognize that alternative embodiments may comprise single heavy or light chain variable domains. The single variable domain may be used to screen for variable domains capable of forming a two-domain specific antigen-binding fragment capable of binding to TMEFF2. The screening may be accomplished by phage display screening methods using for example hierarchical dual combinatorial approach disclosed in Int. Patent Publ. No. WO1992/01047. In this approach, an individual colony containing either a VH or a VL chain clone is used to infect a complete library of clones encoding the other chain (VL or VH), and the resulting two-chain specific antigen-binding domain is selected in accordance with phage display techniques using known methods and those described herein. Therefore, the individual VH and VL polypeptide chains are useful in identifying additional anti-TMEFF2 antibodies using the methods disclosed in Int. Patent Publ. No. WO1992/01047.

Bispecific Anti-TMEFF2/Anti-CD3 Antibodies

The invention also provides an isolated bispecific anti-TMEFF2/anti-CD3 antibody or an antigen binding fragment thereof comprising a first domain that binds TMEFF2 and a second domain that binds CD3, wherein the antibody binds to the membrane proximal region of TMEFF2. While not wishing to be bound by any particular theory, bispecific antibodies binding to the membrane proximal region of TMEFF2 may be more efficient in mediating T-cell mediated killing of tumor cells.

The invention also provides an isolated bispecific anti-TMEFF2/anti-CD3 antibody or an antigen binding fragment thereof comprising a first domain that binds TMEFF2 and a second domain that binds CD3, wherein the antibody competes for binding to the membrane proximal region of TMEFF2 with a reference antibody comprising a heavy chain variable region (VH) of SEQ ID NO: 25 and a light chain variable region (VL) of SEQ ID NO: 28, the VH of SEQ ID NO: 589 and the VL of SEQ ID NO: 29, the VH of SEQ ID NO: 27 and the VL of SEQ ID NO: 30, the VH of SEQ ID NO: 589 and the VL of SEQ ID NO: 31, the VH of SEQ ID NO: 604 and the VL of SEQ ID NO: 607, or the VH of SEQ ID NO: 612 and the VL of SEQ ID NO: 613.

In some embodiments, the isolated bispecific anti-TMEFF2/anti-CD3 antibody or an antigen binding fragment thereof binds the membrane proximal region of TMEFF2 with a dissociation constant ($K_D$) of about $0.4 \times 10^{-9}$ M or less, wherein the $K_D$ is measured using surface plasmon resonance in acetate buffer at pH 4.5-5.0 at room temperature.

In some embodiments, the isolated bispecific anti-TMEFF2/anti-CD3 antibody or the antigen binding fragment thereof binds the membrane proximal region TMEFF2 with the $K_D$ of between about $0.1 \times 10^{-10}$ M and about $0.4 \times 10^{-9}$ M.

The invention also provides an isolated bispecific anti-TMEFF2/anti-CD3 antibody or an antigen binding fragment thereof, wherein the first domain comprises a HCDR1, a HCDR2, a HCDR3, a LCDR1, a LCDR2 and a LCDR3 of
SEQ ID NOs: 582, 584, 587, 18, 588 and 22, respectively;
SEQ ID NOs: 583, 585, 16, 19, 21 and 23, respectively;
SEQ ID NOs: 582, 586, 17, 18, 588 and 24, respectively; o
SEQ ID NOs: 583, 585, 16, 18, 588 and 22, respectively; or
SEQ ID NOs: 582, 584, 587, 18, 588 and 603, respectively.

The invention also provides an isolated bispecific anti-TMEFF2/anti-CD3 antibody or an antigen binding fragment thereof, wherein the second domain comprises the HCDR1, the HCDR2, the HCDR3, the LCDR1, the LCDR2 and the LCDR3 of SEQ ID NOs: 662, 663, 664, 671, 673, and 690, respectively.

The invention also provides an isolated bispecific anti-TMEFF2/anti-CD3 antibody or an antigen binding fragment thereof, wherein the first domain comprises
the VH of SEQ ID NO: 25 and the VL of SEQ ID NO: 28;
the VH of SEQ ID NO: 589 and the VL of SEQ ID NO: 29;
the VH of SEQ ID NO: 27 and the VL of SEQ ID NO: 30;
the VH of SEQ ID NO: 589 and the VL of SEQ ID NO: 31;
the VH of SEQ ID NO: 604 and the VL of SEQ ID NO: 607; or
the VH of SEQ ID NO: 612 and the VL of SEQ ID NO: 613.

The invention also provides an isolated bispecific anti-TMEFF2/anti-CD3 antibody or an antigen binding fragment thereof, wherein the second domain comprises
the VH of SEQ ID NO: 652 and the VL of SEQ ID NO: 661.

In some embodiments, the second domain comprises the VH of SEQ ID NO:657 and the VL of SEQ ID NO: 658.

The invention also provides an isolated bispecific anti-TMEFF2/anti-CD3 antibody or an antigen binding fragment thereof comprising a first domain that binds TMEFF2 and a second domain that binds CD3, wherein
the first domain comprises a HCDR1, a HCDR2, HCDR3, a LCDR1, a LCDR2 and a LCDR3 of SEQ ID NOs: 582, 584, 587, 18, 588 and 22, respectively, and the second domain comprises the HCDR1, the HCDR2, the HCDR3, the LCDR1, the LCDR2 and the LCDR3 of SEQ ID NOs: 662, 663, 664, 671, 673, and 690, respectively;
the first domain comprises a VH of SEQ ID NO: 25 and a VL of SEQ ID NO: 28, and the second domain comprises the VH of SEQ ID NO: 652 and the VL of SEQ ID NO: 661;
the first domain comprises a VH of SEQ ID NO: 25 and a VL of SEQ ID NO: 28, and the second domain comprises the VH of SEQ ID NO: 657 and the VL of SEQ ID NO: 678;
the bispecific anti-TMEFF2/anti-CD3 antibody or the antigen binding fragment thereof comprises a HC1 of SEQ ID NO: 32, a LC1 of SEQ ID NO: 35, a HC2 of SEQ ID NO: 640 and a LC2 of SEQ ID NO: 676; and/or
the bispecific anti-TMEFF2/anti-CD3 antibody or the antigen binding fragment thereof comprises a HC1 of SEQ ID NO: 32, a LC1 of SEQ ID NO: 35, a HC2 of SEQ ID NO: 675 and a LC2 of SEQ ID NO: 677.

The invention also provides an isolated bispecific anti-TMEFF2/anti-CD3 antibody or an antigen binding fragment thereof comprising a first domain that binds TMEFF2 and a second domain that binds CD3, wherein
the first domain comprises a HCDR1, a HCDR2, HCDR3, a LCDR1, a LCDR2 and a LCDR3 of SEQ ID NOs: 583, 585, 16, 19, 21, and 23, respectively, and the second domain comprises the HCDR1, the HCDR2, the HCDR3, the LCDR1, the LCDR2 and the LCDR3 of SEQ ID NOs: 662, 663, 664, 671, 673, and 690, respectively;

the first domain comprises a VH of SEQ ID NO: 589 and a VL of SEQ ID NO: 29, and the second domain comprises the VH of SEQ ID NO: 652 and the VL of SEQ ID NO: 661;

the first domain comprises a VH of SEQ ID NO: 589 and a VL of SEQ ID NO: 29, and the second domain comprises the VH of SEQ ID NO: 657 and the VL of SEQ ID NO: 678 and/or the bispecific anti-TMEFF2/anti-CD3 antibody or the antigen binding fragment thereof comprises a HC1 of SEQ ID NO: 33, a LC1 of SEQ ID NO: 36, a HC2 of SEQ ID NO: 640 and a LC2 of SEQ ID NO: 676;

the bispecific anti-TMEFF2/anti-CD3 antibody or the antigen binding fragment thereof comprises a HC1 of SEQ ID NO: 33, a LC1 of SEQ ID NO: 36, a HC2 of SEQ ID NO: 675 and a LC2 of SEQ ID NO: 677.

The invention also provides an isolated bispecific anti-TMEFF2/anti-CD3 antibody or an antigen binding fragment thereof comprising a first domain that binds TMEFF2 and a second domain that binds CD3, wherein the first domain comprises a HCDR1, a HCDR2, a HCDR3, a LCDR1, a LCDR2 and a LCDR3 of SEQ ID NOs: 582, 586, 17, 18, 588 and 24, respectively, and the second domain comprises the HCDR1, the HCDR2, the HCDR3, the LCDR1, the LCDR2 and the LCDR3 of SEQ ID NOs: 662, 663, 664, 671, 673, and 690, respectively;

the first domain comprises a VH of SEQ ID NO: 27 and a VL of SEQ ID NO: 30, and the second domain comprises the VH of SEQ ID NO: 652 and the VL of SEQ ID NO: 661;

the first domain comprises a VH of SEQ ID NO: 27 and a VL of SEQ ID NO: 30, and the second domain comprises the VH of SEQ ID NO: 657 and the VL of SEQ ID NO: 678, and/or the bispecific anti-TMEFF2/anti-CD3 antibody or the antigen binding fragment thereof comprises a HC1 of SEQ ID NO: 34, a LC1 of SEQ ID NO: 37, a HC2 of SEQ ID NO: 640 and a LC2 of SEQ ID NO: 676;

the bispecific anti-TMEFF2/anti-CD3 antibody or the antigen binding fragment thereof comprises a HC1 of SEQ ID NO: 34, a LC1 of SEQ ID NO: 37, a HC2 of SEQ ID NO: 675 and a LC2 of SEQ ID NO: 677.

The invention also provides an isolated bispecific anti-TMEFF2/anti-CD3 antibody or an antigen binding fragment thereof comprising a first domain that binds TMEFF2 and a second domain that binds CD3, wherein the first domain comprises a HCDR1, a HCDR2, a HCDR3, a LCDR1, a LCDR2 and a LCDR3 of SEQ ID NOs: 583, 585, 16, 18, 588 and 22, respectively, and the second domain comprises the HCDR1, the HCDR2, the HCDR3, the LCDR1, the LCDR2 and the LCDR3 of SEQ ID NOs: 662, 663, 664, 671, 673, and 690, respectively;

the first domain comprises a VH of SEQ ID NO: 589 and a VL of SEQ ID NO: 31, and the second domain comprises the VH of SEQ ID NO: 652 and the VL of SEQ ID NO: 661;

the first domain comprises a VH of SEQ ID NO: 589 and a VL of SEQ ID NO: 31, and the second domain comprises the VH of SEQ ID NO: 657 and the VL of SEQ ID NO: 678; and/or the bispecific anti-TMEFF2/anti-CD3 antibody or the antigen binding fragment thereof comprises a HC1 of SEQ ID NO: 33, a LC1 of SEQ ID NO: 38, a HC2 of SEQ ID NO:640 and a LC2 of SEQ ID NO: 676;

the bispecific anti-TMEFF2/anti-CD3 antibody or the antigen binding fragment thereof comprises a HC1 of SEQ ID NO: 33, a LC1 of SEQ ID NO: 38, a HC2 of SEQ ID NO:675 and a LC2 of SEQ ID NO: 677.

The invention also provides an isolated bispecific anti-TMEFF2/anti-CD3 antibody or an antigen binding fragment thereof comprising a first domain that binds TMEFF2 and a second domain that binds CD3, wherein the first domain comprises a HCDR1, a HCDR2, a HCDR3, a LCDR1, a LCDR2 and a LCDR3 of SEQ ID NOs: 582, 584, 587, 18, 588 and 603, respectively, and the second domain comprises the HCDR1, the HCDR2, the HCDR3, the LCDR1, the LCDR2 and the LCDR3 of SEQ ID NOs: 662, 663, 664, 671, 673, and 690, respectively;

the first domain comprises a VH of SEQ ID NO: 604 and a VL of SEQ ID NO: 607, and the second domain comprises the VH of SEQ ID NO: 652 and the VL of SEQ ID NO: 661;

the first domain comprises a VH of SEQ ID NO: 604 and a VL of SEQ ID NO: 607, and the second domain comprises the VH of SEQ ID NO: 657 and the VL of SEQ ID NO: 678; and/or the bispecific anti-TMEFF2/anti-CD3 antibody or the antigen binding fragment thereof comprises a HC1 of SEQ ID NO: 614, a LC1 of SEQ ID NO: 615, a HC2 of SEQ ID NO: 640 and a LC2 of SEQ ID NO: 676;

the bispecific anti-TMEFF2/anti-CD3 antibody or the antigen binding fragment thereof comprises a HC1 of SEQ ID NO: 614, a LC1 of SEQ ID NO: 615, a HC2 of SEQ ID NO: 675 and a LC2 of SEQ ID NO: 677.

The invention also provides an isolated bispecific anti-TMEFF2/anti-CD3 antibody or an antigen binding fragment thereof comprising a first domain that binds TMEFF2 and a second domain that binds CD3, wherein the first domain comprises a HCDR1, a HCDR2, a HCDR3, a LCDR1, a LCDR2 and a LCDR3 of SEQ ID NOs: 582, 584, 587, 18, 588 and 603, respectively, and the second domain comprises the HCDR1, the HCDR2, the HCDR3, the LCDR1, the LCDR2 and the LCDR3 of SEQ ID NOs: 662, 663, 664, 671, 673, and 690, respectively;

the first domain comprises a VH of SEQ ID NO: 612 and a VL of SEQ ID NO: 613, and the second domain comprises the VH of SEQ ID NO: 652 and the VL of SEQ ID NO: 661;

the first domain comprises a VH of SEQ ID NO: 612 and a VL of SEQ ID NO: 613, and the second domain comprises the VH of SEQ ID NO: 657 and the VL of SEQ ID NO: 678; and/or the bispecific anti-TMEFF2/anti-CD3 antibody or an antigen binding fragment thereof comprises a HC1 of SEQ ID NO: 616, a LC1 of SEQ ID NO: 617, a HC2 of SEQ ID NO: 640 and a LC2 of SEQ ID NO: 676;

the bispecific anti-TMEFF2/anti-CD3 antibody or an antigen binding fragment thereof comprises a HC1 of SEQ ID NO: 616, a LC1 of SEQ ID NO: 617, a HC2 of SEQ ID NO: 675 and a LC2 of SEQ ID NO: 677.

EMBODIMENTS

This invention provides the following non-limiting embodiments.
1. An isolated recombinant anti-CD3 antibody, or antigen-binding fragment thereof, comprising:
  a) a heavy chain comprising a heavy chain complementarity determining region (HCDR) 1 comprising SEQ ID NO: 662; a HCDR2 comprising SEQ ID NO: 663; and a HCDR3 comprising SEQ ID NO: 664 and a light chain comprising a light chain complementarity determining region (LCDR) 1 comprising SEQ ID NO: 671, a LCDR2 comprising SEQ ID NO: 673, and a LCDR3 comprising SEQ ID NO: 690;

b) a heavy chain variable region comprising SEQ ID NO: 652 and a light chain variable region comprising SEQ ID NO: 661;

c) a heavy chain comprising SEQ ID NO: 640 and a light chain comprising SEQ ID NO: 676;

d) a heavy chain comprising a HCDR1 comprising SEQ ID NO: 662; a HCDR2 comprising SEQ ID NO: 663; and a HCDR3 comprising SEQ ID NO: 664 and a light chain comprising a LCDR1 comprising SEQ ID NO: 773, a LCDR2 comprising SEQ ID NO: 673, and a LCDR3 comprising SEQ ID NO: 690;

e) a heavy chain variable region comprising SEQ ID NO: 657 and a light chain variable region comprising SEQ ID NO: 678; or f) a heavy chain comprising SEQ ID NO: 675 and a light chain comprising SEQ ID NO: 678.

2. An isolated recombinant anti-CD3 antibody or antigen-binding fragment thereof, wherein the antibody or antigen-binding fragment specifically binds *Macaca fascicularis* or human CD3d, or CD3e, or CD3e and CD3d with a binding affinity of about 300 nM or less.

3. The isolated recombinant anti-CD3 antibody or antigen-binding fragment thereof of embodiment 2, wherein the binding affinity is about 100 nM or less.

4. The isolated recombinant anti-CD3 antibody or antigen-binding fragment thereof of embodiment 2 or 3, wherein the binding affinity is measured by flow cytometry or by Proteon surface plasmon resonance assay ProteOn XPR36 system at +25° C.

5. The isolated recombinant anti-CD3 antibody or antigen-binding fragment thereof of any one of the previous embodiments, wherein the antibody or antigen-binding fragment has one, two, three, or four of the following properties:

a) binds human and *Macaca fascicularis* CD3+T lymphocytes with a calculated EC50 of 300 nM or less and binds *Macaca fascicularis* CD3-expressing HEK cells with a calculated EC50 of 300 nM or less, wherein the difference in calculated EC50 between binding CD3+T lymphocytes and binding *Macaca fascicularis* CD3-expressing HEK cells is less than 5-fold, and wherein the calculated EC50 is measured in a whole cell binding assay at 0° C. using flow cytometry;

b) binds recombinant CD3d from human (SEQ ID NO:691), or binds recombinant CD3e from human (SEQ ID NO:636), or binds recombinant CD3d from *Macaca fascicularis* (SEQ ID NO:692), or binds recombinant CD3e from *Macaca fascicularis* (SEQ ID NO:693) with an equilibrium dissociation constant ($K_D$) of 300 nM or less, wherein the $K_D$ is measured using Proteon surface plasmon resonance assay ProteOn XPR36 system at +25° C.;

c) binds residues 1-6 of CD3e as determined by X-ray crystallography; or d) activates T cells or induces CD69 expression to a similar degree as cOKT3 or SP34-2 as determined by fluorescence-activated cell sorting assay.

6. The antibody or antigen-binding fragment thereof of any one of the previous embodiments comprising at least one substitution in an antibody constant domain, the at least one substitution comprising:

a) heavy chain substitutions K409R, F405L, or F405L and R409K;

b) heavy chain substitutions S228P, F234A, and L235A;

c) heavy chain substitutions L234A, G237A, P238S, H268A, A330S and P331S, wherein the antibody is an IgG1 isotype; or d) heavy chain substitution S228P, wherein the antibody is an IgG4 isotype; wherein residue numbering is according to the EU Index.

7. The antibody or antigen-binding fragment thereof of any one of the previous embodiments, comprising the HCDR1, the HCDR2, the HCDR3, the LCDR1, the LCDR2, and the LCDR3 of SEQ ID NOs:662, 663, 664, 671, 673, and 690, respectively.

8. The antibody or antigen-binding fragment thereof of any one of the previous embodiments, comprising a heavy chain variable region (VH) and a light chain variable region (VL) of SEQ ID NOs:652 and 661, respectively.

9. The antibody or antigen-binding fragment thereof of any one of the previous embodiments, comprising a heavy chain sequence (HC) and a light chain sequence (LC) of SEQ ID NOs:640 and 676, respectively.

10. The antibody or antigen-binding fragment thereof of any one of embodiments 1-5, comprising the HCDR1, the HCDR2, the HCDR3, the LCDR1, the LCDR2, and the LCDR3 of SEQ ID NOs:662, 663, 664, 773, 673, and 690, respectively.

11. The antibody or antigen-binding fragment thereof of any one of embodiments 1-5, comprising a VH and a VL of SEQ ID NOs:657 and 678, respectively.

12. The antibody or antigen-binding fragment thereof of any one of embodiments 1-5, comprising a HC and a LC of SEQ ID NOs:675 and 677, respectively.

13. An antibody or antigen-binding fragment thereof, comprising the HCDR1, the HCDR2, the HCDR3, the LCDR1, the LCDR2, and the LCDR3 of SEQ ID NOs: 662, 663, 664, 671, 673, and 690, respectively.

14. An antibody or antigen-binding fragment thereof, comprising a VH and a VL of SEQ ID NOs:652 and 661, respectively.

15. An antibody or antigen-binding fragment thereof, comprising a HC and a LC of SEQ ID NOs:640 and 676, respectively.

16. An antibody or antigen-binding fragment thereof, comprising the HCDR1, the HCDR2, the HCDR3, the LCDR1, the LCDR2, and the LCDR3 of SEQ ID NOs: 662, 663, 664, 773, 673, and 690, respectively.

17. An antibody or antigen-binding fragment thereof, comprising a VH and a VL of SEQ ID NOs:657 and 678, respectively.

18. An antibody or antigen-binding fragment thereof, comprising a HC and a LC of SEQ ID NOs:675 and 677, respectively.

19. The antibody or antigen-binding fragment thereof of any one of the previous embodiments, wherein the antibody is human or humanized.

20. The antibody of embodiment 19, wherein the antibody is an IgG4 or IgG1 isotype.

21. The antibody of embodiment 20, comprising one, two, three, four, five, six, seven, eight, nine or ten substitutions in the antibody Fc.

22. The antibody of embodiment 18, comprising:

a) D43G, L49M, L50I, S62N, Q85E light chain substitutions;

b) D43G, V48L, L49M, L50I, S62N, Q85E, H89Y light chain substitutions;

c) R10G, R13K, V73I, R70K, T83S, L96V heavy chain substitutions;

d) any one of light chain substitutions D43G, V48L, L49M, L50I, S62N, Q85E, or H89Y; or e) any one of heavy chain substitutions R10G, R13K, V73I, R79K, T83S, or L96V, wherein residue numbering for light chain substitutions is according to SEQ ID No: 661, and for heavy chain substitutions is according to SEQ ID No: 652.

23. The antibody of any one of the previous embodiments, wherein the antibody is bispecific or multispecific.

24. A bispecific antibody comprising a first domain that specifically binds CD3 and a second domain that specifically binds a second antigen, wherein the first domain comprises the HCDR1, the HCDR2, the HCDR3, the LCDR1, the LCDR2, and the LCDR3 of SEQ ID NOs: 662, 663, 664, 671, 673, and 690, respectively.

25. The bispecific antibody of embodiment 24 wherein the first domain and second domain are an IgG4 isotype, and wherein the first or the second domain comprises S228P, F234A, L235A, F405L and R409K heavy chain substitutions and the other domain of the first or the second domain comprises S228P, F234A and L235A heavy chain substitution, wherein residue numbering is according to the EU Index.

26. The bispecific antibody of embodiment 24, wherein the first and/or the second domain comprises at least one substitution in a CH3 constant domain comprising a F405L, or F405L and R409K substitution, wherein residue numbering is according to the EU Index.

27. The bispecific antibody of embodiment 24, wherein one of the first or the second domains comprises a F405L heavy chain substitution and the other of the first or second domains comprises a K409R heavy chain substitution, wherein residue numbering is according to the EU Index.

28. The bispecific antibody of embodiment 24, wherein the first domain and the second domain are an IgG4 isotype, wherein one of the first or the second domains comprises a S228P heavy chain substitution and the other of the first or the second domains comprises S228P, F405L and R409K heavy chain substitutions, wherein residue numbering is according to the EU Index.

29. The bispecific antibody of claim 24, wherein the first domain comprises the VH and the VL of SEQ ID NOs: 652 and 661, respectively.

30. The bispecific antibody of claim 24, wherein the first domain comprises the HC and the LC of SEQ ID NOs: 640 and 676, respectively.

31. The bispecific antibody of claim 24, wherein the first domain comprises the VH and the VL of SEQ ID NOs: 657 and 678, respectively.

32. The bispecific antibody of claim 24, wherein the first domain comprises the HC and the LC of SEQ ID NOs:675 and 677, respectively.

33. The bispecific antibody of claim 24, wherein the second antigen is a cell surface antigen that is expressed on a target cell other than an immune effector cell.

34. The bispecific antibody of claim 33, wherein the cell surface antigen is a tumor associated antigen.

35. The bispecific antibody of any one of claims 24-34, wherein the second antigen is CD33, IL1RAP, PSMA or TMEFF2.

36. The bispecific antibody of embodiment 35, wherein the first domain comprises the HCDR1, HCDR2, the HCDR3, the LCDR1, the LCDR2, and the LCDR3 of SEQ ID NOs:662, 663, 664, 671, 673, and 690, respectively; and wherein the second domain comprises the HCDR1, HCDR2, the HCDR3, the LCDR1, the LCDR2, and the LCDR3 of SEQ ID NOs:78, 683, 80, 81, 792, and 686, respectively.

37. The bispecific antibody of embodiment 33, wherein the first domain comprises the VH and VL of SEQ ID NOs:652 and 661, respectively; and wherein the second domain comprises the VH and VL of SEQ ID NOs:681 and 682, respectively.

38. The bispecific antibody of embodiment 33, wherein the first domain comprises the HC and LC of SEQ ID NOs:640 and 676, respectively; and wherein the second domain comprises the HC and LC of SEQ ID NOs:679 and 680, respectively.

39. The bispecific antibody of embodiment 33, wherein the first domain comprises the HCDR1, HCDR2, the HCDR3, the LCDR1, the LCDR2, and the LCDR3 of SEQ ID NOs:662, 663, 664, 671, 673, and 690, respectively; and wherein the second domain comprises the HCDR1, HCDR2, the HCDR3, the LCDR1, the LCDR2, and the LCDR3 of SEQ ID NOs:78, 3, 80, 81, 792 and 686, respectively.

40. The bispecific antibody of embodiment 33, wherein the first domain comprises the VH and VL of SEQ ID NOs:652 and 661, respectively; and wherein the second domain comprises the VH and VL of SEQ ID NOs 8 and 682, respectively.

41. The bispecific antibody of embodiment 33, wherein the first domain comprises the HC and LC of SEQ ID NOs:640 and 676, respectively; and wherein the second domain comprises the HC and LC of SEQ ID NOs 13 and 680, respectively.

42. The bispecific antibody of embodiment 33, wherein the first domain comprises the HCDR1, HCDR2, the HCDR3, the LCDR1, the LCDR2, and the LCDR3 of SEQ ID NOs:662, 663, 664, 671, 673, and 690, respectively; and wherein the second domain comprises the HCDR1, HCDR2, the HCDR3, the LCDR1, the LCDR2, and the LCDR3 of SEQ ID NOs:78, 79, 80, 81, 82 and 83, respectively.

43. The bispecific antibody of embodiment 33, wherein the first domain comprises the VH and VL of SEQ ID NOs:652 and 661, respectively; and wherein the second domain comprises the VH and VL of SEQ ID NOs:116 and 117, respectively.

44. The bispecific antibody of embodiment 33, wherein the first domain comprises the HC and LC of SEQ ID NOs:640 and 676, respectively; and wherein the second domain comprises the HC and LC of SEQ ID NOs:138 and 139, respectively.

45. The bispecific antibody of embodiment 31, wherein the first domain comprises the HCDR1, HCDR2, the HCDR3, the LCDR1, the LCDR2, and the LCDR3 of SEQ ID NOs: 662, 663, 664, 671, 673, and 670, respectively; and wherein the second domain comprises the HCDR1, HCDR2, the HCDR3, the LCDR1, the LCDR2, and the LCDR3 of SEQ ID NOs:164, 165, 166, 167, 168, and 169, respectively.

46. The bispecific antibody of embodiment 31, wherein the first domain comprises the VH and VL of SEQ ID NOs:652 and 661, respectively; and wherein the second domain comprises the VH and VL of SEQ ID NOs:215 and 216, respectively.

47. The bispecific antibody of embodiment 31, wherein the first domain comprises the HCDR1, HCDR2, the HCDR3, the LCDR1, the LCDR2, and the LCDR3 of SEQ ID NOs: 662, 663, 664, 671, 673, and 670, respectively; and wherein the second domain comprises the HCDR1, HCDR2, the HCDR3, the LCDR1, the LCDR2, and the LCDR3 of SEQ ID NOs:349, 390, 341, 471, 513, and 555, respectively.

48. The bispecific antibody of embodiment 31, wherein the first domain comprises the VH and VL of SEQ ID NOs:652 and 661, respectively; and wherein the second domain comprises the VH and VL of SEQ ID NOs:267 and 306, respectively.

49. The bispecific antibody of embodiment 31, wherein the first domain comprises the HCDR1, HCDR2, the HCDR3, the LCDR1, the LCDR2, and the LCDR3 of SEQ ID NOs: 662, 663, 664, 671, 673, and 670, respectively; and wherein the second domain comprises the HCDR1, HCDR2, the HCDR3, the LCDR1, the LCDR2, and the LCDR3 of SEQ ID NOs:363, 404, 445, 485, 527, and 569, respectively.

50. The bispecific antibody of embodiment 31, wherein the first domain comprises the VH and VL of SEQ ID NOs:652 and 661, respectively; and wherein the second domain comprises the VH and VL of SEQ ID NOs:281 and 320, respectively.

51. A pharmaceutical composition comprising the antibody of any one of the previous embodiments and a pharmaceutically acceptable carrier.

52. A polynucleotide encoding the antibody of any one of the embodiments 1-50.

53. A vector comprising the polynucleotide of embodiment 52.

54. A host cell comprising the vector of embodiment 53.

55. A method of producing the antibody of any one of embodiments 1-50, comprising culturing the host cell of embodiment 52 in conditions that the antibody is expressed, and recovering the antibody produced by the host cell.

56. A method of treating a cancer in a subject, comprising administering a therapeutically effective amount of the isolated antibody of any one of embodiments 1-50 to the subject in need thereof for a time sufficient to treat the cancer.

57. The method of embodiment 56, wherein the cancer is a solid tumor or a hematological malignancy.

58. The method of embodiment 57, wherein the solid tumor is a prostate cancer, a colorectal cancer, a gastric cancer, a clear cell renal carcinoma, a bladder cancer, a lung cancer, a squamous cell carcinoma, a glioma, a breast cancer, a kidney cancer, a neovascular disorder, a clear cell renal carcinoma (CCRCC), a pancreatic cancer, a renal cancer, a urothelial cancer or an adenocarcinoma to the liver.

59. The method of embodiment 58, wherein the prostate cancer is a refractory prostate cancer, a prostatic intraepithelial neoplasia, an androgen independent prostate cancer, or a malignant prostate cancer.

60. The method of embodiment 57, wherein the hematological malignancy is acute myeloid leukemia (AML), myelodysplastic syndrome (MDS), acute lymphocytic leukemia (ALL), diffuse large B-cell lymphoma (DLBCL), chronic myeloid leukemia (CML) or blastic plasmacytoid dendritic cell neoplasm (DPDCN).

61. The method of any one of embodiments 56-60, wherein the antibody is administered in combination with a second therapeutic agent.

62. The antibody of any one of embodiments 1-50 for use in therapy.

63. An anti-idiotypic antibody binding to the antibody of any one of embodiments 1-50.

EXAMPLES

1 De Novo Generation and Functional Characterization of Anti-CD3 mAbs 1-1 Immunization of OmniRats® with CD3 Antigens to Generate CD3 Monoclonal Antibodies OmniRats® were immunized with proprietary vectors (Aldevron, Fargo, N. Dak., USA) encoding for: human CD3e and human CD3d; cynomolgus CD3e and cynomolgus CD3d. Animals received alternating boosts with human and cynomolgus DNA. From the 6th application on, the animals received optimized vectors with the same insert. Cells from lymph nodes were fused with the Ag8 myeloma cell line. 40 million cells from fusion BLW were put on three 96-well plates following IgM depletion. 133 million cells from fusion BLX were put on nine 96-well plates without IgM depletion.

Hybridoma supernatants from fusions BLW (with magnetic bead depletion of lymphocytes) and BLX (without magnetic bead depletion of lymphocytes) were analyzed a) by a cell-based ELISA (CELISA) on cells transiently transfected with human and cynomolgus cDNA cloned into screening vectors: pOPT-CD3e-hum-epsilon-TCE.OMT+pOPT-CD3d-hum-delta.OMT, 1:1 (pOPT-CD3e/d-hum-mix) and pcDNA3.1-CD3e-cyn-delta+pcDNA3.1-CD3d-cyn-delta, 1:1 (pcDNA3.1-CD3e/d-cyn-mix). Human and cynomolgus cDNA sequences (and corresponding amino acid sequences) are provided in Table 4. For CELISA negative control, non-transfected mammalian cells were incubated with hybridoma supernatants and detected with the secondary Bethyl antibody. For a CELISA transfection control, mammalian cells, transfected with the constructs described above, were detected with anti-tag antibody.

Hybridoma supernatants were further analyzed by flow cytometry (FACS) on CD3 positive and CD3 negative Jurkat cells: Jurkat CD3+ (E6-1) and Jurkat CD3− (J.RT3-T3.5). For FACS negative control, CD3 negative Jurkat cells (J.RT3-T3.5), were incubated with dilution buffer and detected with Southern anti-rat Ig HRP and Bethyl anti-rat IgG1, 2a, 2b, 2c-HRP secondary antibodies.

The specificity of the antibodies in the hybridoma supernatants of the hybridomas from fusion BLW and fusion BLX for human and cynomolgus CD3e/d complex presented on transiently transfected cells or, in the case of the human CD3e/d complex on Jurkat CD3+(E6-1) cells, was demonstrated by CELISA on transiently transfected cells, as well as when tested in FACS on Jurkat cell lines (Table 3). No significant signal was detected for any samples in the experimental samples serving as negative controls.

TABLE 3

Test of the specificity of individual hybridoma supernatants by cell-based ELISA (top) and by flow-cytometry (bottom). CELISA values represent the relative fluorescence units (rfu) of each sample. FACS values represent the geometric means (geomean) of the relative fluorescence intensities of each sample.

| | | Cell based ELISA (relative fluorescence units) Hybridoma supernatants incubated on cells transfected with: | | | | | |
|---|---|---|---|---|---|---|---|
| | | pOPT-CD3e/d-hum-mix | | pcDNA3.1-CD3e/d-cyn-mix | | Non-transfected CHO negative control | |
| No | Clone | Rfu | % positive | Rfu | % positive | Rfu | % positive |
| | | BLW: fusion with lymphocytes from immunization group MR14-379 rat 1&2 (magnetic-bead depletion of IgM+ applied) | | | | | |
| 1 | BLW-2B4 | 689 | 101 | 230 | 47 | 30 | |
| 2 | BLW-2E6 | 231 | 34 | 121 | 25 | 20 | |
| 3 | BLW-3B4 | 867 | 127 | 320 | 66 | 24 | |
| | | BLX: fusion with lymphocytes from immunization group MR14-379 rat 1&2 (without magnetic-bead depletion of IgM+) | | | | | |
| 4 | BLX-1F8 | 689 | 101 | 230 | 47 | 30 | |
| 5 | BLX-2E9 | 867 | 127 | 320 | 66 | 24 | |
| 6 | BLX-3F4 | 896 | 131 | 371 | 76 | 17 | |
| 7 | BLX-3G8 | 759 | 111 | 340 | 70 | 22 | |
| 8 | BLX-4D9 | 1042 | 153 | 483 | 99 | 24 | |
| 9 | BLX-6A2 | 110 | 16 | 38 | 8 | 19 | |
| | Positive control | 682 | 100 | 488 | 100 | — | |
| | Negative control | 25 | 4 | 42 | 9 | — | |

| | | Flow Cytometry (FACS) Hybridoma supernatants incubated on Jurkat cell line | | | |
|---|---|---|---|---|---|
| | | Jurkat CD3+ (E6-1) | | Jurkat CD3− (J.RT3.T3.5) negative control | |
| No | Clone | geomean | % positive | geomean | % positive |
| | | BLW: fusion with lymphocytes from immunization group MR14-379 rat 1&2 (magnetic-bead depletion of IgM+ applied) | | | |
| 1 | BLW-2B4 | 148034 | 53 | 4012 | |
| 2 | BLW-2E6 | 7503 | 3 | 687 | |
| 3 | BLW-3B4 | 198849 | 72 | 2884 | |
| | | BLX: fusion with lymphocytes from immunization group MR14-379 rat 1&2 (without magnetic-bead depletion of IgM+) | | | |
| 4 | BLX-1F8 | 148034 | 53 | 4012 | |
| 5 | BLX-2E9 | 198849 | 72 | 2884 | |
| 6 | BLX-3F4 | 181963 | 66 | 4613 | |
| 7 | BLX-3G8 | 214697 | 77 | 3096 | |

TABLE 3-continued

Test of the specificity of individual hybridoma supernatants by cell-based ELISA (top) and by flow-cytometry (bottom). CELISA values represent the relative fluorescence units (rfu) of each sample. FACS values represent the geometric means (geomean) of the relative fluorescence intensities of each sample.

| 8 | BLX-4D9 | 25839 | 9 | 1471 |
|---|---|---|---|---|
| 9 | BLX-6A2 | 3385 | 1 | 1219 |
| | Positive control | 277338 | 100 | 2051 |
| | Negative control | 869 | 0 | 599 |

TABLE 4

| CD3 sequences used for immunization | |
|---|---|
| Human CD3d | NP_000723.1 (www.uniprot.org/uniprot/P04234) (SEQ ID NO: 691) |
| Human CD3e | (NP_000724.1 (www.uniprot.org/uniprot/P07766) (SEQ ID NO: 636) |
| Cyno CD3d | XP_001097302 (www.uniprot.org/uniprot/Q95LI8) (SEQ ID NO: 692) |
| Cyno CD3e | CD3e + TCE (www.uniprot.org/uniprot/Q95LI5) (SEQ ID NO: 693) |

1-2 Cloning Anti-CD3 Antibodies

Anti-human CD3 antibodies were generated in OmniRats (OMT, Palo Alto, Calif., USA). Variable region ("V region") sequences of these clones were extracted from the genomic sequences and analyzed. All sequences obtained were either human IgG heavy chain or lambda light chain and the sequences, especially LC, showed high homology. Aligning the sequences to germline showed some mutations in the framework (FIG. 1). The V-region DNA sequences were synthesized and cloned into mammalian expression vectors, heavy chain sequences into human IgG1 vector and light chain sequences into human lambda vector. Sequences are shown in Tables 6 and 7. Seven mAbs were assigned protein identifiers (Table 5A).

CD3B312 was chosen as the most representative clone and the heavy chain sequences were cloned into human IgG1sigma and IgG4 PAA with S228P, F234A, L235A mutations and assigned protein identifiers as shown in Table 5B. These were used to generate bispecific antibodies and to demonstrate T cell redirection functionality through cytotoxicity.

TABLE 5A

| Peptide ID and protein ID of clones | | | |
|---|---|---|---|
| clone ID | HC peptide ID | LC peptide ID | protein ID |
| BLW-2B4 | CD3H218 | CD3L123 | CD3B311 |
| BLW-2E6 | CD3H219 | CD3L124 | CD3B312 |
| BLW-3B4 | CD3H218 | CD3L125 | CD3B313 |
| BLX-1F8 | CD3H220 | CD3L126 | CD3B314 |
| BLX-2E9 | CD3H221 | CD3L124 | CD3B315 |
| BLX-3F4 | CD3H222 | CD3L124 | CD3B316 |
| BLX-3G8 | CD3H223 | CD3L124 | CD3B317 |

TABLE 5B

CD3B312 was chosen as the most representative clone and the heavy chain sequences were cloned into human IgG1 sigma and IgG4 PAA with mutations and assigned protein identifiers.

| IgG1 | IgG1sigma | IgG4PAA |
|---|---|---|
| CD3B312 | CD3B337 | CD3B373 |

TABLE 6

Heavy chain and light chain sequences of 7 monoclonal CD3 antibodies

| Protein AA ID | Heavy Chain Amino Acid Sequence | SEQ ID NO. | Light Chain Amino Acid Sequence | SEQ ID NO. |
|---|---|---|---|---|
| CD3B311 (BLW-2B4) | HC Peptide ID: CD3H218 QVQLQQSGPGLVKPSQTLSLTCAISGDSVFN NNAAWTWIRQSPSRGLEWLGRTYYRSKWLYD YAVSVKSRITVNPDTSRNQFTLQLKSVTPED TALYYCSRGYSSSFDYWGQGTLVTVSSASTK GPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPP KPKDTLMISRTPEVTCVVVDVSHEDPEVKFN WYVDGVEVHNAKTKPREEQYNSTYRVVSVLT VLHQDWLNGKEYKCKVSNKALPAPIEKTISK AKGQPREPQVYTLPPSREEMTKNQVSLTCLV KGFYPSDIAVEWESNGQPENNYKTTPPVLDS DGSFFLYSKLTVDKSRWQQGNVFSCSVMHEA LHNHYTQKSLSLSPGK | (637) | LC Peptide ID: CD3L123 QSALTQPASVSGSPGQSITISCTGTSSNIGT YKFVSWYQQHPDKAPKVLLYEVSKRPSGVSS RFSGSKSGNTASLTISGLQAEDQADYHCCSY AGSGTLLFGGGTKLTVLGQPKAAPSVTLFPP SSEELQANKATLVCLISDFYPGAVTVAWKAD SSPVKAGVETTTPSKQSNNKYAASSYLSLTP EQWKSHRSYSCQVTHEGSTVEKTVAPTECS | (645) |
| CD3B312 (BLW-2E6) | HC Peptide ID: CD3H219 QVRLQQSGPGLVKPSQTLSLTCAISGDSVFN NNAAWSWIRQSPSRGLEWLGRTYYRSKWLYD YAVTVKSRITVNPDTSRNQFTLQLTSVTPED | (640) | LC Peptide ID: CD3L124 QSALTQPASVSGSPGQSITISCTGTSSNIGT YKFVSWYQQHPDKAPKVLLYEVSKRPSGVSS RFSGSKSGNTASLTISGLQAEDQADYHCCSY | (646) |

TABLE 6-continued

Heavy chain and light chain sequences of 7 monoclonal CD3 antibodies

| Protein AA ID | Heavy Chain Amino Acid Sequence | SEQ ID NO. | Light Chain Amino Acid Sequence | SEQ ID NO. |
|---|---|---|---|---|
| | TALYYCARGYSSSFDYWGQGTLVTVSSASTK GPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPP KPKDTLMISRTPEVTCVVVDVSHEDPEVKFN WYVDGVEVHNAKTKPREEQYNSTYRVVSVLT VLHQDWLNGKEYKCKVSNKALPAPIEKTISK AKGQPREPQVYTLPPSREEMTKNQVSLTCLV KGFYPSDIAVEWESNGQPENNYKTTPPVLDS DGSFFLYSKLTVDKSRWQQGNVFSCSVMHEA LHNHYTQKSLSLSPGK | | AGSGTLLFGGGTKLTVLGQPKAAPSVTLFPP SSEELQANKATLVCLISDFYPGAVTVAWKAD SSPVKAGVETTTPSKQSNNKYAASSYLSLTP EQWKSHRSYSCQVTHEGSTVEKTVAPTECS | |
| CD3B313 (BLW-3B4) | HC Peptide ID: CD3H218 QVQLQQSGPGLVKPSQTLSLTCAISGDSVFN NNGAWSWIRQSPSRGLEWLGRTYYRSKWLYD YAVSVKSRITVNPDTSRNQFTLQLNSVTPED TALYYCARGYSSSFDYWGQGTLVTVSSASTK GPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPP KPKDTLMISRTPEVTCVVVDVSHEDPEVKFN WYVDGVEVHNAKTKPREEQYNSTYRVVSVLT VLHQDWLNGKEYKCKVSNKALPAPIEKTISK AKGQPREPQVYTLPPSREEMTKNQVSLTCLV KGFYPSDIAVEWESNGQPENNYKTTPPVLDS DGSFFLYSKLTVDKSRWQQGNVFSCSVMHEA LHNHYTQKSLSLSPGK | (638) | LC Peptide ID: CD3L125 QSALTQPASVSGSPGQSITISCTGTSSNIGT YKFVSWYQQHPDKAPKVLLYEVSKRPSGVSS RFSGSKSGNTASLTISGLQAEDQADYHCCSY AGSGTLLFGGGTKLTVLGQPKAAPSVTLFPP SSEELQANKATLVCLISDFYPGAVTVAWKAD SSPVKAGVETTTPSKQSNNKYAASSYLSLTP EQWKSHRSYSCQVTHEGSTVEKTVAPTECS | (649) |
| CD3B314 (BLX-1F8) | HC Peptide ID: CD3H220 QVQLQQSGPGLVKPSQTLSLTCAISGDSVFN NNAAWSWIRQSPSRGLEWLGRTYYRSKWLYD YAVSVKSRITVNPDTSRNQFTLQLKSVTPED TALYYCSRGYSSSFDYWGQGTLVTVSSASTK GPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPP KPKDTLMISRTPEVTCVVVDVSHEDPEVKFN WYVDGVEVHNAKTKPREEQYNSTYRVVSVLT VLHQDWLNGKEYKCKVSNKALPAPIEKTISK AKGQPREPQVYTLPPSREEMTKNQVSLTCLV KGFYPSDIAVEWESNGQPENNYKTTPPVLDS DGSFFLYSKLTVDKSRWQQGNVFSCSVMHEA LHNHYTQKSLSLSPGK | (641) | LC Peptide ID: CD3L126 QSALTQPASVSGSPGQSITISCTGTSSDIGT YKFVSWYQQHPDKAPKVLLYEVSKRPSGVSS RFSGSKSDNTASLTISGLQAEDQADYHCCSY AGSGTLLFGGGTKLTVLGQPKAAPSVTLFPP SSEELQANKATLVCLISDFYPGAVTVAWKAD SSPVKAGVETTTPSKQSNNKYAASSYLSLTP EQWKSHRSYSCQVTHEGSTVEKTVAPTECS | (650) |
| CD3B315 (BLX-2E9) | HC Peptide ID: CD3H221 QVQLQQSGPGLVKPSQTLSLTCAISGDSVFN NNAAWSWIRQSPSRGLEWLGRTYYRSKWLYD YAVSVKSRITVNPDTSRNQFTLQLNSVTPED TALYYCVRGYSSSFDYWGQGTLVTVSSASTK GPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPP KPKDTLMISRTPEVTCVVVDVSHEDPEVKFN WYVDGVEVHNAKTKPREEQYNSTYRVVSVLT VLHQDWLNGKEYKCKVSNKALPAPIEKTISK AKGQPREPQVYTLPPSREEMTKNQVSLTCLV KGFYPSDIAVEWESNGQPENNYKTTPPVLDS DGSFFLYSKLTVDKSRWQQGNVFSCSVMHEA LHNHYTQKSLSLSPGK | (642) | LC Peptide ID: CD3L124 QSALTQPASVSGSPGQSITISCTGTSRDIGT YKFVSWYQQHPDKAPKVLLYEVSKRPSGVSS RFSGSKSGNTASLTISGLQAEDQADYHCCSY AGSGTLLFGGGTKLTVLGQPKAAPSVTLFPP SSEELQANKATLVCLISDFYPGAVTVAWKAD SSPVKAGVETTTPSKQSNNKYAASSYLSLTP EQWKSHRSYSCQVTHEGSTVEKTVAPTECS | (647) |
| CD3B316 (BLX-3F4) | HC Peptide ID: CD3H222 QVQLQQSGPRLVRPSQTLSLTCAISGDSVFN NNAAWSWIRQSPSRGLEWLGRTYYRSKWLYD YAVSVKSRITVNPDTSRNQFTLQLNSVTPED TALYYCARGYSSSFDYWGQGTLVTVSSASTK GPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPP KPKDTLMISRTPEVTCVVVDVSHEDPEVKFN WYVDGVEVHNAKTKPREEQYNSTYRVVSVLT | (643) | LC Peptide ID: CD3L124 QSALTQPASVSGSPGQSITISCTGTSSNIGT YKFVSWYQQHPDKAPKVLLYEVSKRPSGVSS RFSGSKSGNTASLTISGLQAEDQADYHCCSY AGSGTLLFGGGTKLTVLGQPKAAPSVTLFPP SSEELQANKATLVCLISDFYPGAVTVAWKAD SSPVKAGVETTTPSKQSNNKYAASSYLSLTP EQWKSHRSYSCQVTHEGSTVEKTVAPTECS | (646) |

TABLE 6-continued

Heavy chain and light chain sequences of 7 monoclonal CD3 antibodies

| Protein AA ID | Heavy Chain Amino Acid Sequence | SEQ ID NO. | Light Chain Amino Acid Sequence | SEQ ID NO. |
|---|---|---|---|---|
| | VLHQDWLNGKEYKCKVSNKALPAPIEKTISK AKGQPREPQVYTLPPSREEMTKNQVSLTCLV KGFYPSDIAVEWESNGQPENNYKTTPPVLDS DGSFFLYSKLTVDKSRWQQGNVFSCSVMHEA LHNHYTQKSLSLSPGK | | | |
| CD3B317 (BLX-3G8) | HC Peptide ID: CD3H223 QVQLQQSGPGLVKPSQTLSLTCAISGDSVFN NNAAWSIRQSPSRGLEWLGRTYYRSKWLYD YAVSVKSRITVNPDTSRNQFTLQLNSVTPED TALYYCVRGYSSSFDYWGQGTLVTVSSASTK GPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPP KPKDTLMISRTPEVTCVVVDVSHEDPEVKFN WYVDGVEVHNAKTKPREEQYNSTYRVVSVLT VLHQDWLNGKEYKCKVSNKALPAPIEKTISK AKGQPREPQVYTLPPSREEMTKNQVSLTCLV KGFYPSDIAVEWESNGQPENNYKTTPPVLDS DGSFFLYSKLTVDKSRWQQGNVFSCSVMHEA LHNHYTQKSLSLSPGK | (644) | LC Peptide ID: CD3L124 QSALTQPASVSGSPGQSITISCTGTSRDIGT YKFVSWYQQHPDKAPKVLLYEVNKRPSGVSS RFSGSKSGNTASLTISGLQAEDQADYHCCSY AGSGTLLFGGGTKLTVLGQPKAAPSVTLFPP SSEELQANKATLVCLISDFYPGAVTVAWKAD SSPVKAGVETTTPSKQSNNKYAASSYLSLTP EQWKSHRSYSCQVTHEGSTVEKTVAPTECS | (648) |

TABLE 7A

VH and VL sequences with HC and LC isotype of 7 monoclonal CD3 antibodies from the first panel of 9 described above (see Table 3). All HC isotypes were huIgG1_G1m(17). All LC isotypes were huLambda 2.

| Fab ID | Peptide ID | VH (SEQ ID NO:) | Peptide ID | VL (SEQ ID NO:) |
|---|---|---|---|---|
| CD3B311 | CD3H218 | qvqlqqsgpglvkpsqtlslt caisgdsvfnnnaawswirqs psrglewlgrtyyrskwlydy avsvksritvnpdtsrnqftl qlnsvtpedtalyycvrgyss sfdywgqgtlvtvss (651) | CD3L123 | qsaltqpasvsgspggsitisct gtsrdigtykfvswyqqhpdkap kvllyevnkrpsgvssrfsgsks gntasltisglqaedqadyhccs yagsgtllfgggtkltvl (658) |
| CD3B312 | CD3H219 | qvqlqqsgpprlvrpsqtlslt caisgdsvfnnnaawswirqs psrglewlgrtyyrskwlydy avsvksritvnpdtsrnqftl qlnsvtpedtalyycargyss sfdywgqgtlvtvss (652) | CD3L124 | qsaltqpasvsgspggsitisct gtssnigtykfvswyqqhpdkap kvllyevskrpsgvssrfsgsks gntasltisglqaedqadyhccs yagsgtllfgggtkltvl (659) |
| CD3B313 | CD3H218 | qvqlqqsgpglvkpsqtlslt caisgdsvfnnnaawswirqs psrglewlgrtyyrskwlydy avsvksritvnpdtsrnqftl qlnsvtpedtalyycvrgyss sfdywgqgtlvtvss (687) | CD3L124 | qsaltqpasvsgspggsitisct gtsrdigtykfvswyqqhpdkap kvllyevskrpsgvssrfsgsks gntasltisglqaedqadyhccs yagsgtllfgggtkltvl (688) |
| CD3B314 | CD3H220 | qvqlqqsgpglvkpsqtlslt caisgdsvfnnnaawswirqs psrglewlgrtyyrskwlydy avsvksritvnpdtsrnqftl qlksvtpedtalyycsrgyss sfdywgqgtlvtvss (653) | CD3L126 | qsaltqpasvsgspggsitisct gtssdigtykfvswyqqhpdkap kvllyevskrpsgvssrfsgsks dntasltisglqaedqadyhccs yagsgtllfgggtkltvl (660) |
| CD3B315 | CD3H221 | qvqlqqsgpglvkpsqtlslt caisgdsvfnnngawswirqs psrglewlgrtyyrskwlydy avsvksritvnpdtsrnqftl qlnsvtpedtalyycargyss sfdywgqgtlvtvss (654) | CD3L124 | qsaltqpasvsgspggsitisct gtssnigtykfvswyqqhpdkap kvllyevskrpsgvssrfsgsks gntasltisglqaedqadyhccs yagsgtllfgggtkltvl (659) |

TABLE 7A-continued

VH and VL sequences with HC and LC isotype of 7 monoclonal CD3 antibodies from the first panel of 9 described above (see Table 3). All HC isotypes were huIgG1_G1m(17). All LC isotypes were huLambda_2.

| Fab ID | Peptide ID | VH (SEQ ID NO:) | Peptide ID | VL (SEQ ID NO:) |
|---|---|---|---|---|
| CD3B316 | CD3H222 | qvrlqqsgpglvkpsqtlslt caisgdsvfnnnaawswirqs psrglewlgrtyyrskwlydy avtvksritvnpdtsrnqftl qltsvtpedtalyycargyss sfdywgqgtlvtvss (655) | CD3L124 | qsaltqpasvsgspggsitisct gtssnigtykfvswyqqhpdkap kvllyevskrpsgvssrfsgsks gntasltisglqaedqadyhccs yagsgtllfgggtkltvl (659) |
| CD3B317 | CD3H223 | qvqlqqsgpglvkpsqtlslt caisgdsvfnnnaawtwirqs psrglewlgrtyyrskwlydy avsvksritvnpdtsrnqftl qlksvtpedtalyycsrgyss sfdywgqgtlvtvss (656) | CD3L124 | qsaltqpasvsgspggsitisct gtssnigtykfvswyqqhpdkap kvllyevskrpsgvssrfsgsks gntasltisglqaedqadyhccs yagsgtllfgggtkltvl (659) |

TABLE 7B

CDR sequences with HC and LC isotype of 7 monoclonal CD3 antibodies from the first panel of 9 described above (see Table 3). Sequences are defined according to Kabat. All HC isotypes were huIgG1_G1m(17). All LC isotypes were huLambda_2.

| FAB ID | Peptide ID | CDR1 | CDR2 | CDR3 |
|---|---|---|---|---|
| CB3B311 | HC CD3H218 | NNNAAWS (662) | RTYYRSKWLYDYAVSVKS (663) | GYSSSFDY (664) |
| | LC CD3L123 | TGTSRDIGTYKFVS (667) | EVNKRPS (669) | CSYAGSGTLL (670) |
| CD3B312 | HC CD3H219 | NNNAAWS (662) | RTYYRSKWLYDYAVSVKS (663) | GYSSSFDY (664) |
| | LC CD3L124 | TGTSSNIGTYKFVS (671) | EVSKRPS (673) | CSYAGSGTLL (670) |
| CD3B313 | HC CD3H218 | NNNAAWS (662) | RTYYRSKWLYDYAVSVKS (663) | GYSSSFDY (664) |
| | LC CD3L124 | TGTSRDIGTYKFVS (672) | EVSKRPS (673) | CSYAGSGTLL (670) |
| CD3B314 | HC CD3H220 | NNNAAWS (662) | RTYYRSKWLYDYAVSVKS (663) | GYSSSFDY (664) |
| | LC CD3L126 | TGTSSDIGTYKFVS (674) | EVSKRPS (673) | CSYAGSGTLL (670) |
| CD3B315 | HC CD3H221 | NNNGAWS (665) | RTYYRSKWLYDYAVSVKS (663) | GYSSSFDY (664) |
| | LC CD3L124 | TGTSSNIGTYKFVS (671) | EVSKRPS (673) | CSYAGSGTLL (670) |
| CD3B316 | HC CD3H222 | NNNAAWS (662) | RTYYRSKWLYDYAVTVKS (689) | GYSSSFDY (664) |
| | LC CD3L124 | TGTSSNIGTYKFVS (671) | EVSKRPS (673) | CSYAGSGTLL (670) |
| CD3B317 | HC CD3H223 | NNNAAWT (666) | RTYYRSKWLYDYAVSVKS (663) | GYSSSFDY (664) |
| | LC CD3L124 | TGTSSNIGTYKFVS (671) | EVSKRPS (673) | CSYAGSGTLL (670) |

Figure 2:
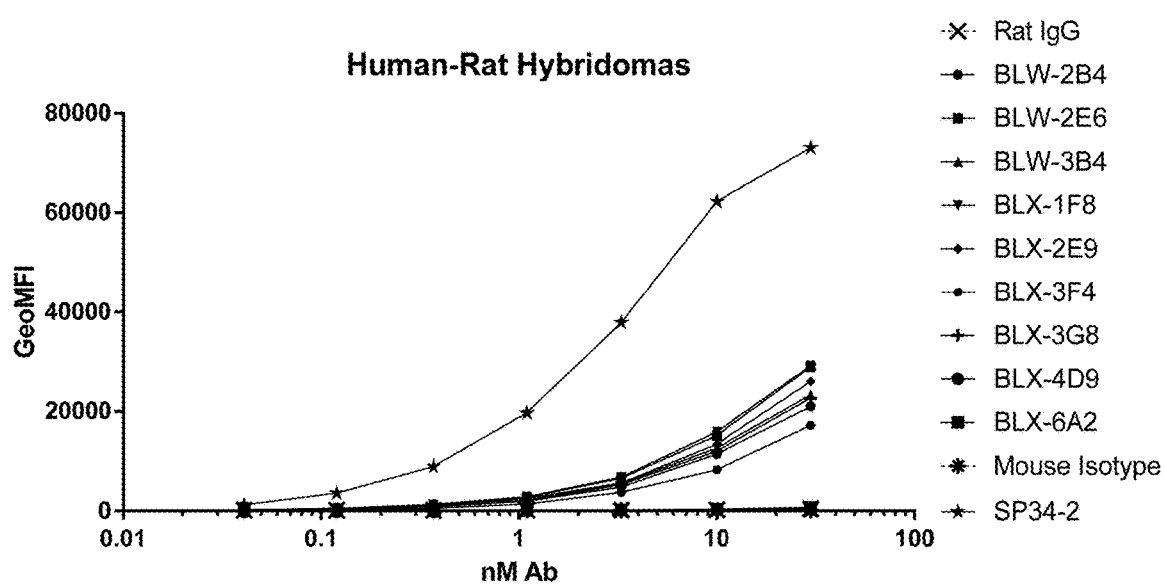
FIG. 2 shows a cell-based binding assay to assess the binding capacity of individual rat hybridoma supernatants to human purified CD3+T lymphocytes.
Figure 3:
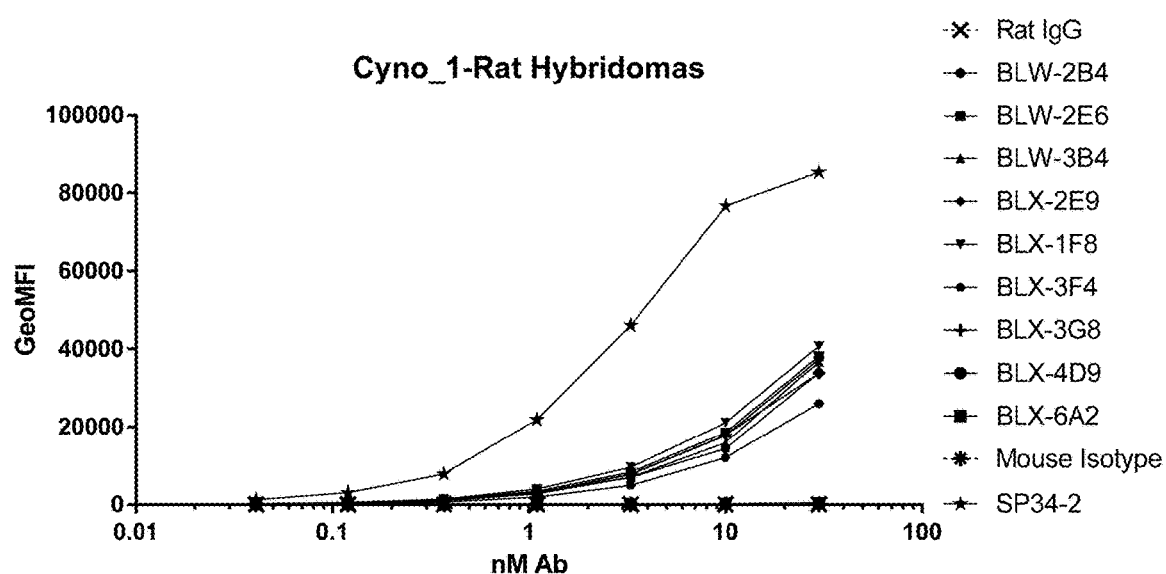
FIG. 3 shows a cell-based binding assay to assess the binding capacity of individual rat hybridoma supernatants to cynomolgus purified CD3+T lymphocytes.

1-3 Screening of Hybridomas for Binding to Human and Cynomolgus Purified T Cells A cell-based binding assay was designed to assess the binding capacity of individual rat hybridoma supernatants to human (FIG. 2) and cynomolgus (FIG. 3) purified CD3+T lymphocytes. The T cells were counted, diluted to 1×10^6 cells/mL and incubated with 0.5 ul/mL of Live/Dead Fixable Green Dead Cell Stain (Life Technologies, L-2301). Next the cells were aliquoted into a U-bottom (Falcon 353077) plate at 100 ul/well (1×10^5 cells/well). The plates were centrifuged at 300 g for 5 minutes to pellet the cells and the supernatant removed. The plate was vortexed briefly to resuspend the cells. The hybridoma supernatants were diluted in FACS staining buffer (BSA, BD Biosciences 554657) to 4.5 µg/mL and then serially diluted 6 times at 1:3 dilutions to the lowest concentration of 0.006 µg/mL. A positive control of mouse anti-human CD3 (SP34-2, BD Biosciences 551916) and negative isotype control (mouse IgG1 BD Biosciences 556648) were also diluted to 4.5 µg/mL. 50 µl of each sample was added to the T cells and incubated at 4° C. for 1 hour. The cells were washed once with staining buffer and secondary AF647 Goat anti-mouse IgG (Life Technologies, A21235) or AF647 goat anti-rat IgG (Life Technologies, A21247) was added at 10 µg/mL in 50 µl was added according to the appropriate species (anti-rat for hybridoma samples and anti-mouse for the control antibodies). The plates were incubated at 4° C. for 45 minutes and washed with staining buffer twice. The cells were resuspended in 25 µl of running buffer (staining buffer+1 mM EDTA (Life technologies, AM9260G)+0.1% pluronic F-68 (Life Technologies 24040-032)) and read on the Intellicyt system (Intellicyt Corp.). The results are shown in FIGS. 2 and 3.

Figure 5:
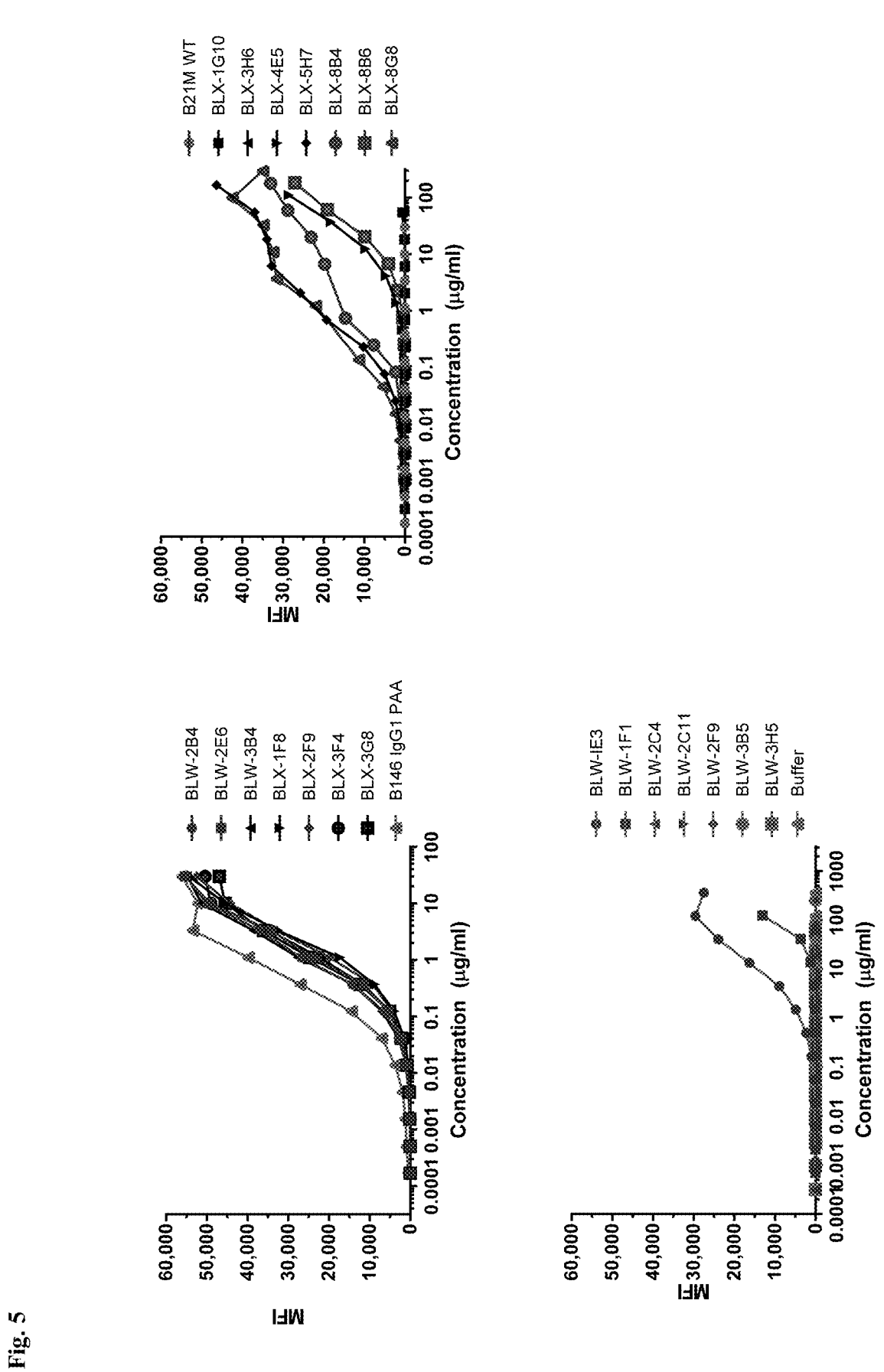
FIG. 5 shows representative binding curves of anti-CD3 antibodies on primary human T cells.

In other experiments, purified human T cells were plated at $1.1\times10^5$ cells/well in U-bottom plates. The plates were centrifuged at 300 g for 5 minutes to pellet the cells and the supernatant removed. The plate was vortexed briefly to resuspend the cells. The hybridoma supernatants were diluted in FACS staining buffer (BSA, BD Biosciences 554657) to 30 ug/mL and then serially diluted 11 times at 1:3 dilutions to the lowest concentration of 0.00017 ug/mL. 50 ul of each sample was added to the T cells and incubated at 4 C for 1 hour. The cells were washed once with staining buffer and secondary Dylight 650 goat anti-rat IgG (Bethyl, A110-239D5) was added at 10 ug/mL in 50 ul was added. The plates were incubated at 4 C for 1 hour and washed with staining buffer twice. The cells were resuspended in 30 ul of FACS buffer and read on the Hypercyte flow cytometer (Intellicyt Corp.). Representative dose-response curves for the anti-CD3 clones binding to primary human T cells are shown in FIG. 5.

Figure 6:
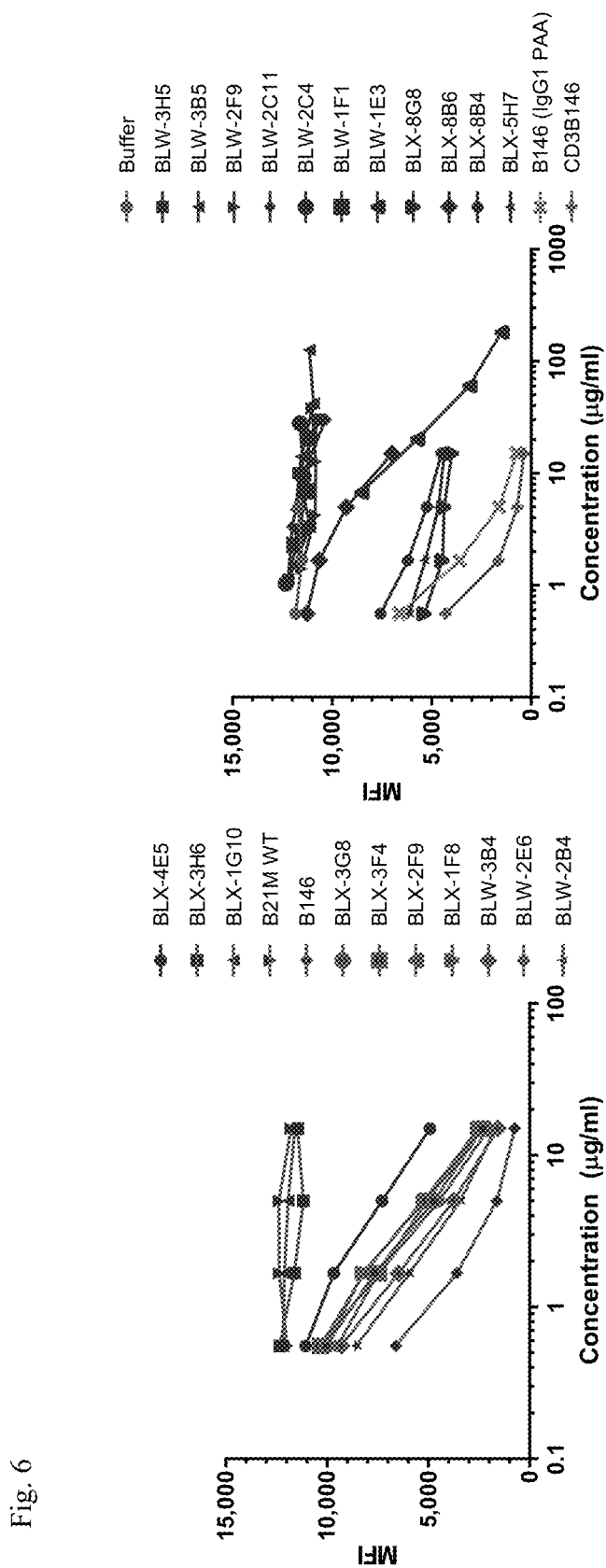
FIG. 6 shows representative competition binding curves of anti-CD3 antibodies with AlexaFluor 488 conjugated SP34-2 on primary human T cells.

Representative competition binding curves with SP34-2 (a commercial anti-human CD3 antibody which has a known epitope and is cross-reactive with cynomolgus CD3) are shown in FIG. 6. The initial screening results are summarized in Table 8. Six of the clones showed positive binding and also compete with SP34-2 for binding to primary human T cells.

1-4 Competition Assay with SP34-2 Commercial CD3 Antibody

The hybridoma supernatants were also assessed for their ability to compete with commercial anti-human CD3 antibody SP34-2 which has a known epitope and is cross-reactive with cynomolgus CD3. First a concentration titration curve of AF488 fluorescently labelled SP34-2 (BD, 557705) was performed to determine a fixed concentration of SP34-2 for the following competition assays. Briefly, human purified T cells were diluted to $1\times10^6$ cell/mL in PBS. Fc block (Human TruStain Fc Block, Biolegend, 422302) was added at 5 µL/100 µL cells and plated at 100 µL/well in U-bottom plates. AF488 SP34-2 and the AF488 labelled isotype control (AF488 mouse IgG1, BD, 400129) were serially diluted from 50 µg/mL to 0.049 µg/mL in a 1:2 dilution scheme. The plates were centrifuged at 300×g for 5 minutes to pellet the cells and the supernatant removed. The plate was gently vortexed briefly to resuspend the cells. 50 µL of each AF488 SP34-2 dilution was added to the cells and incubated at 4 C for 1 hour. The plates were washed with staining buffer twice and once with running buffer (staining buffer+1 mM EDTA (Life technologies, AM9260G)+0.1% pluronic F-68 (Life Technologies 24040-032)). The cells were resuspended in 25 µL of running buffer and read on the HTFC Screening System (IntelliCyt Corporation). Based on the dose response curve, a fixed concentration of 2 ug/mL SP34-2 was chosen for the competition assay.

Figure 4:
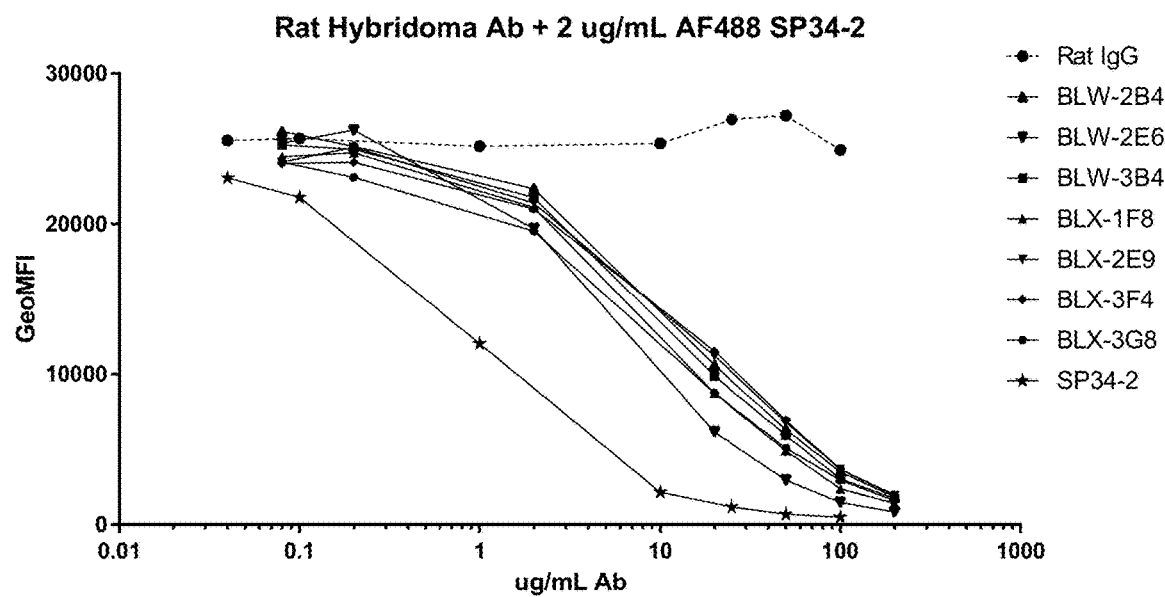
FIG. 4 shows competition assay results of hybridoma supernatants assessed for their ability to compete with commercial anti-human CD3 antibody SP34-2, which has a known epitope and is cross-reactive with cynomolgus CD3.

Seven hybridomas that demonstrated binding to purified T cells were assayed for competition with SP34-2 binding to human T cells (FIG. 4). Control antibodies were included in the competition assay. Unlabeled Mouse Anti-Human CD3, SP34-2 antibody and Mouse Anti-Human CD3, UCHT1 antibody were used as positive controls and rat IgG and Mouse isotype were used as negative controls for AF488 labeled SP34-2. Purified human T cells were diluted to a concentration of $1\times10^6$ cells/mL in PBS. Fc block at 5 µL per 100 µL cells (Human TruStain Fc Block, Biolegend, 422302) and Live/Dead Fixable Far Red Dead Cell Stain at 0.5 µL per mL cells (Life Technologies L10120) were added to the cells and incubated for 15 minutes at 4° C. Next, $10^5$ cells per well ($1\times10^5$ cells/well) were aliquoted into a 96-well U-bottom plate (Falcon 353077). The plates were centrifuged at 300×g for 5 minutes to pellet the cells and the supernatant removed. The plate was gently vortexed briefly to resuspend the cells. The hybridoma supernatants and the control antibodies were diluted in FACS staining buffer (BSA, BD Biosciences 554657) at 2× the desired final concentration. 35 µL of the 2× hybridoma supernatants and the control antibodies were mixed with 35 uL of 2× AF488 SP34-2 (4 µg/mL) to give the desired 1× concentration of hybridoma supernatants, 1× concentration of control antibodies and 2 µg/mL AF488 SP34-2. The hybridoma supernatants and control antibodies were assayed using a 7-point titration with a concentration range. Hybridoma supernatants were assayed from 200 µg/mL to 0.08 µg/mL and control antibodies were assayed from 100 µg/mL to 0.04 µg/mL. 50 uL of the 1× hybridoma supernatants or 1× control antibodies with 2 µg/mL AF488 SP34-2 were added to the T cells and incubated at 4° C. for 2 hours. The plates were washed with staining buffer twice and once with running buffer (staining buffer+1 mM EDTA (Life technologies, AM9260G)+0.1% pluronic F-68 (Life Technologies 24040-032)). The cells were resuspended in 25 µL of running buffer and read on the HTFC Screening System (IntelliCyt Corporation). Representative competition binding curves with SP34-2 (a commercial anti-human CD3 antibody which has a known epitope and is cross-reactive with cynomolgus CD3) are shown in FIG. 4 and FIG. 6. The initial screening results are summarized in Table 8. Six of the clones showed positive binding and also competed with SP34-2 for binding to primary human T cells.

As shown in FIG. 4 the seven antibodies competed with SP34-2 with similar curves. The right shift of the curves relative to the control SP34-2 indicates a weaker binding affinity. The isotype control rat IgG did not compete with SP34-2, as expected.

TABLE 8

Summary of anti-CD3 antibody binding on primary human T cells. Anti-CD3 clones BLX-4E5, BLX-5H7, BLX-8B4, BLX-8B6, BLX-8G8 and BLW-1E3 were positive for binding to human T cells and competed with SP34-2 binding

| Ab clone | Binds with human T cells | Competes with SP34-2 |
|---|---|---|
| BLW-2B4 | + | + |
| BLW-2E6 | + | + |
| BLW-3B4 | + | + |

TABLE 8-continued

Summary of anti-CD3 antibody binding on primary human
T cells. Anti-CD3 clones BLX-4E5, BLX-5H7, BLX-8B4,
BLX-8B6, BLX-8G8 and BLW-1E3 were positive for binding
to human T cells and competed with SP34-2 binding

| Ab clone | Binds with human T cells | Competes with SP34-2 |
|---|---|---|
| BLX-1F8 | + | + |
| BLX-2E9 | + | + |
| BLX-3F4 | + | + |
| BLX-3G8 | + | + |
| BLX-1G10 | − | − |
| BLX-3H6 | − | − |
| BLX-4E5 | + | + |
| BLX-5H7 | + | + |
| BLX-8B4 | + | + |
| BLX-8B6 | + | + |
| BLX-8G8 | + | + |
| BLW-1E3 | + | + |
| BLW-1F1 | + | − |
| BLW-2C4 | − | − |
| BLW-2C11 | − | − |
| BLW-2F9 | − | − |
| BLW-3B5 | − | − |
| BLW-3H5 | − | − |

1-5 Screening of Hybridoma Hits for T Cell Activation as Measured by CD69 Upregulation A primary human and cynomolgus monkey T cell based assay was used to determine the capacity of the hybridoma hits to activate T cells. This was accomplished by coating antibodies to a plate to mimic the cross-linking effect of TCR activation. Upon activation, T cells are known to upregulate the surface expression of the protein, CD69. The experiment was conducted by coating 50 µl of a 10 µg/ml antibody preparation with unknown samples or controls (positive control: in house, Okt-3 BISB264.002, BD Bioscience SP-34-2 #551916; negative control: anti-CD20 in house BISB266.004) to a 96 well plate (Costar #3361). The plates were incubated overnight at 4° C. The next day the plates were washed twice with PBS. Frozen primary T cells (human sourced from Biological Specialities or Hemacare; cynomolgus sourced from WorldWide Primates) were thawed, counted for viability and resuspended at $2\times10^6$ cell/ml in RPMI 1640 medium (Gibco #11875 with 10% HI FBS (Gibco #10062). 100 µl of the cells was added to the plate and incubated overnight (approximately 16 hours) at 37 C, 5% $CO_2$. The following day the plates were spun at 1300 rpm for 3 minutes to pellet the cells and the supernatants were discarded. The cells were washed once in PBS and spun as before. 10 µl of a 2.5% solution of Live/Dead Green Fixable Dye (Life Technologies #L23101) in PBS was added to each well and incubated at room temperature and in the dark for 10 minutes. Next 50 µl of a 1% solution of anti-CD69 AF488 (Biolegend #310916 lot #B125271) in FACS buffer (BD Biosciences #554657) was added and the plates were incubated for 45 minutes at 4° C. The plates were washed twice by pelleting the cells as before and discarding the supernatant and resuspending in 150 µl of FACS buffer. After the final wash the cells were resuspended in 150 µl of FACS buffer and read on the FACS Canto. As seen in FIG. 20, the positive controls cOkt3 and SP34-2 induced the upregulation of CD69 on human T cells as indicated by the measured mean fluorescence intensity of the anti-CD69 staining. Only SP34-2 induced CD69 expression in the cynomolgus T cells, as it binds to a region of CD3 sequence that is conserved from monkey to man. The OKT3 anti-CD3 clone did not bind cynomolgus CD3 and did not induce CD69 upregulation. The negative control in both human and cynomolgus T cells was an anti-CD20 which is not expressed on T cells. Of the hybridoma clones that were tested for T cell activation, several induced CD69 expression to a similar degree as the positive control, namely 2B4, 2E6, 3B4, 1F8, 2E9, 3F4, 3G8, 4E5, 5H7, 8B4, 8G8 and 1F1. Most also bound and activated cynomolgus T cells except for 5H7, 8B4, and 8G8.

1-6 Framework Engineering of BLW-2E6

Clones showed high homology and carried framework mutations comparing to human immunoglobulin germline sequences (FIGS. 1A and 1B). Clone 2E6 was selected to adapt the standard framework sequence. All 6 mutations on HC and 7 mutations on LC were mutated back to human germline sequence, either individually or combined (Table 9). The mutated V-region DNA sequences were synthesized and cloned into the same mammalian expression vectors as their parental constructs. The HC and LC constructs were paired via matrix format to generate proteins carrying individual or combinatorial mutations and protein activity was tested. V48 on LC could not be changed back to germline. All other back mutations were not critical but reduced activity to some degree.

TABLE 9

BLW-2E6 framework variants.

| | peptide ID |
|---|---|
| Heavy chain back mutation to human germline | |
| WT | CD3H219 |
| R10G | CD3H225 |
| R13K | CD3H226 |
| V73I | CD3H227 |
| R79K | CD3H228 |
| T83S | CD3H229 |
| L96V | CD3H230 |
| R10G/R13K/V73I/R79K/T83S/L96V | CD3H231 |
| Light chain back mutation to human germline | |
| WT | CD3L124 |
| D43G | CD3L128 |
| V48L | CD3L129 |
| L49M | CD3L130 |
| L50I | CD3L131 |
| S62N | CD3L132 |
| Q85E | CD3L133 |
| H89Y | CD3L134 |
| D43G/L49M/L50I/S62N/Q85E | CD3L135 |
| D43G/L49M/L50I/S62N/Q85E/H89Y | CD3L137 |
| D43G/V48L/L49M/L50I/S62N/Q85E/H89Y | CD3L136 |
| D43G/L49M/L50I/S62N/Q85E/H89Y/C91V | CD3L197 |

Figure 7:
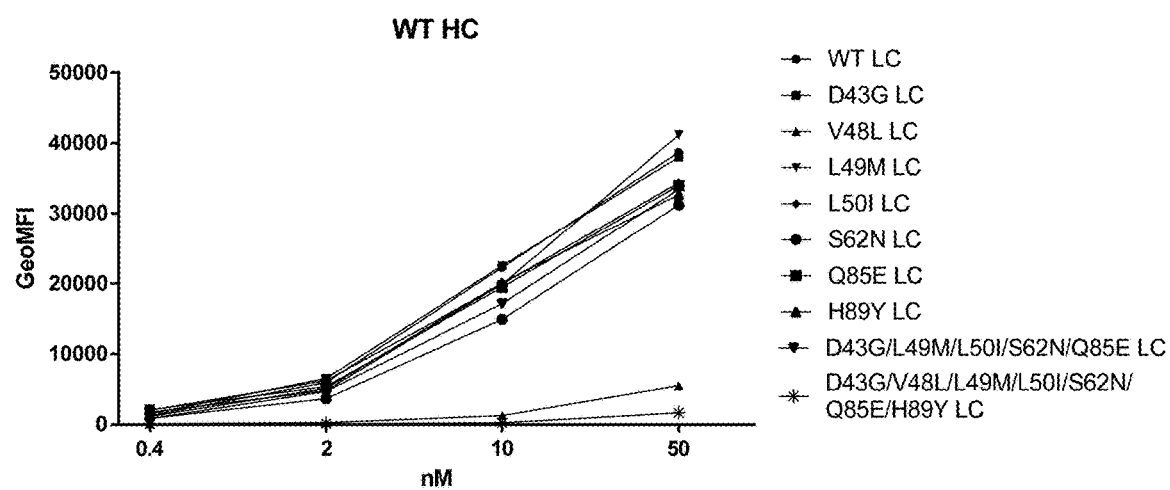
FIG. 7 shows binding of light chain (LC) engineered BLW-2E6 mAbs to primary human T cells.
Figure 8:
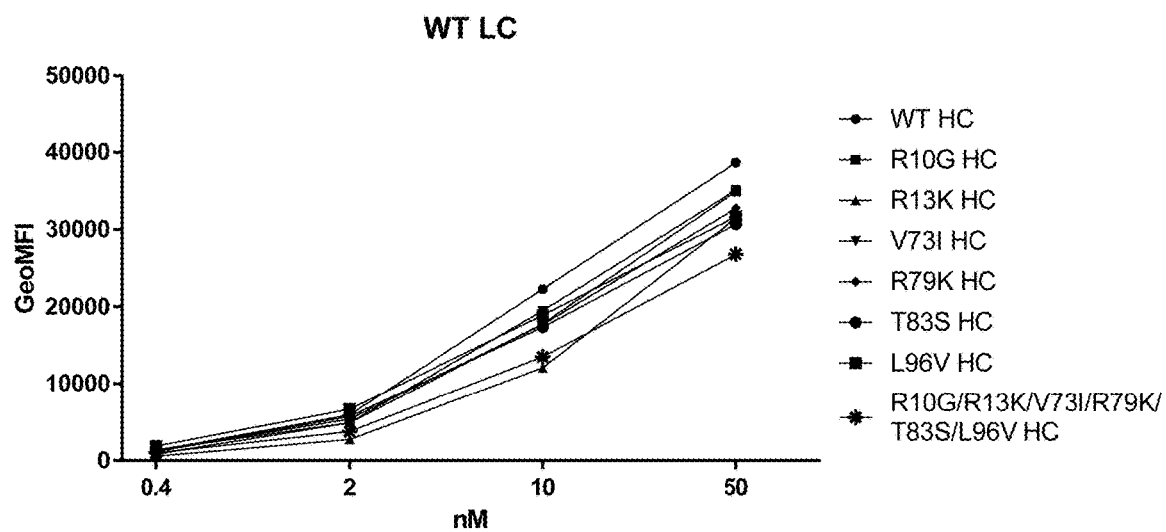
FIG. 8 shows binding of heavy chain (HC) engineered BLW-2E6 to primary human T cells.

Framework mutations were engineered to one hybridoma clone, BLW-2E6, resulting in 80 mutant clones, some of which are indicated in Table 10. The 80 mutant clones were assayed for binding to primary human T cells (FIGS. 7 and 8). The T cells were counted, diluted to 1×10^6 cells/mL and incubated with 5 µL Fc block (Human TruStain Fc Block, Biolegend, 422302) per 100 µL cells and 0.5 µl per mL of Live/Dead Fixable Green Dead Cell Stain (Life Technologies, L-2301) per 100 µL cells. Next, the cells were aliquoted into a 96-well U-bottom plate (Falcon 353077) at 100 µL/well (1×10≡cells/well). The plates were centrifuged at 300×g for 5 minutes to pellet the cells and the supernatant removed. The plate was gently vortexed briefly to resuspend the cells. The hybridoma supernatants were diluted in FACS staining buffer (BSA, BD Biosciences 554657) to 7.5 µg/mL, 1.5 ug/mL, 0.3 µg/mL, and 0.06 µg/mL. 50 µL of each sample was added to the T cells and incubated at 4° C. for 1 hour. The cells were washed once with staining buffer, and 50 µL of 5 µg/mL secondary AF647 goat anti-Human IgG F(ab')2 (Jackson ImmunoResearch catalog 109-605-097) was added to the cells. The plates were incubated at 4° C. for 45 minutes and washed with staining buffer twice and once with running buffer (staining buffer+1 mM EDTA (Life technologies, AM9260G)+0.1% pluronic F-68 (Life Technologies 24040-032)). The cells were resuspended in 25 µL of running buffer and read on the HTFC Screening System (IntelliCyt Corporation). The results demonstrate that a change in the LC at position 48 abolished binding so that mutation was not carried forward. A slight reduction in binding was seen in the HC with all positions returned to germline (CD3H231).

1-7 C91 Scanning of BLW-2E6 LC

Clone 2E6 and its derivatives expressed poorly and protein aggregation was observed. One residue, C91 of light chain, was predicted to have post-translational modification (PTM) risk and was mutated to all other possible amino acids to improve protein stability (Table 10). The mutated V-region DNA sequences were synthesized and cloned into the same human lambda expression vector as their parental construct. The SPR results demonstrated a change to valine or leucine at position 91 did not dramatically alter binding affinity. This change was also incorporated into wild type sequence and the framework adaptation above resulting in antibodies CD3B376 (CD3H219/CD3L150) and CD3B450 (CD3H231/CD3L197). CD3B376 and CD3B450 were cloned as IgG4PAA (IgG4 with S228P, F234A, L235A mutations).

Sequence information for CD3B376 is provided below:

```
CD3H219 HC amino acid sequence (SEQ ID NO: 640):
QVQLQQSGPRLVRPSQTLSLTCAISGDSVFNNNAAWSWIRQSPSRGLEWLGRTYYRSKWLYDYAVSVKSRITVN

PDTSRNQFTLQLNSVTPEDTALYYCARGYSSSFDYWGQGTLVTVSSASTKGPSVFPLAPCSRSTSESTAALGCL

VKDYFPEPVTVSWNSGALTSGVHTFPAVLQSSGLYSLSSVVTVPSSSLGTKTYTCNVDHKPSNTKVDKRVESKY

GPPCPPCPAPEAAGGPSVFLFPPKPKDTLMISRTPEVTCVVVDVSQEDPEVQFNWYVDGVEVHNAKTKPREEQF

NSTYRVVSVLTVLHQDWLNGKEYKCKVSNKGLPSSIEKTISKAKGQPREPQVYTLPPSQEEMTKNQVSLTCLVK

GFYPSDIAVEWESNGQPENNYKTTPPVLDSDGSFLLYSKLTVDKSRWQEGNVFSCSVMHEALHNHYTQKSLSLS

LGK

CD3H219 HC nucleic acid sequence (SEQ ID NO: 712)
caggtgcagctgcagcagtctggccctagactcgtgcggccttcccagaccctgtctctgacctgtgccatctc cggcgactccgtgttcaacaacaacgccgcctggtcctggatccggcagagcccttctagaggcctggaatggc tgggccggacctactaccggtccaagtggctgtacgactacgccgtgtccgtgaagtcccggatcaccgtgaac cctgacacctcccggaaccagttcaccctgcagctgaactccgtgaccctgaggacaccgccctgtactactg cgccagaggctactcctcctccttcgactattggggccagggcaccctcgtgaccgtgtcctct CD3L150 LC amino acid sequence (SEQ ID NO: 676):
QSALTQPASVSGSPGQSITISCTGTSSNIGTYKFVSWYQQHPDKAPKVLLYEVSKRPSGVSSRFSGSKSGNTAS

LTISGLQAEDQADYHCVSYAGSGTLLFGGGTKLTVLGQPKAAPSVTLFPPSSEELQANKATLVCLISDFYPGAV

TVAWKADSSPVKAGVETTTPSKQSNNKYAASSYLSLTPEQWKSHRSYSCQVTHEGSTVEKTVAPTECS

CD3L150 LC nucleic acid sequence (SEQ ID NO: 713)
cagtctgctctgacccagcctgcctccgtgtctggctctcccggccagtccatcaccatcagctgtaccggcac ctcctccaacatcggcacctacaagttcgtgtcctggtatcagcagcaccccgacaaggcccccaaagtgctgc tgtacgaggtgtccaagcggccctctggcgtgtcctccagattctccggctccaagtctggcaacaccgcctcc ctgaccatcagcggactgcaggctgaggaccaggccgactaccactgtgtgtcctacgctggctctggcaccct gctgtttggcggaggcaccaagctgaccgtgctg VH amino acid sequence of CD3H219 (SEQ ID NO: 652):
qvqlqqsgprlvrpsqtlsltcaisgdsvfnnnaawswirqspsrglewlgrtyyrskwlydyavsvksritvn pdtsrnqftlqlnsvtpedtalyycargysssfdywgqgtlvtvss VL amino acid sequence of CD3L150 (SEQ ID NO: 661):
qsaltqpasvsgspgqsitisctgtssnigtykfvswyqqhpdkapkvllyevskrpsgvssrfsgsksgntas ltisglqaedqadyhcvsyagsgtllfgggtkltvl HCDR1 of CD3H219 (SEQ ID NO: 662): NNNAAWS HCDR2 of CD3H219 (SEQ ID NO: 663): RTYYRSKWLYDYAVSVKS HCDR3 of CD3H219 (SEQ ID NO: 664): GYSSSFDY
```

-continued

LCDR1 of CD3L150 (SEQ ID NO: 671): TGTSSNIGTYKFVS

LCDR2 of CD3L150 (SEQ ID NO: 673): EVSKRPS

LCDR3 of CD3L150 (SEQ ID NO: 690): VSYAGSGTLL

Sequence information for CD3B450 is provided below:

CD3H231 HC amino acid sequence (SEQ ID NO: 675):
QVQLQQSGPGLVKPSQTLSLTCAISGDSVFNNNAAWSWIRQSPSRGLEWLGRTYYRSKWLYDYAVSVKSRITIN
PDTSKNQFSLQLNSVTPEDTAVYYCARGYSSSFDYWGQGTLVTVSSASTKGPSVFPLAPCSRSTSESTAALGCL
VKDYFPEPVTVSWNSGALTSGVHTFPAVLQSSGLYSLSSVVTVPSSSLGTKTYTCNVDHKPSNTKVDKRVESKY
GPPCPPCPAPEAAGGPSVFLFPPKPKDTLMISRTPEVTCVVVDVSQEDPEVQFNWYVDGVEVHNAKTKPREEQF
NSTYRVVSVLTVLHQDWLNGKEYKCKVSNKGLPSSIEKTISKAKGQPREPQVYTLPPSQEEMTKNQVSLTCLVK
GFYPSDIAVEWESNGQPENNYKTTPPVLDSDGSFLLYSKLTVDKSRWQEGNVFSCSVMHEALHNHYTQKSLSLS
LGK CD3H231 HC nucleic acid sequence (SEQ ID NO: 714):
caggtgcagctgcagcagagcggccccggcctggtcaagcccagccagaccctgagcctgacctgcgccatcag
cggcgacagcgtgttcaacaacaacgccgcctggtcctggatccgccagagccccagccgcggcctggagtggc
tgggccgcacctactaccgcagcaagtggctgtacgactacgccgtgtccgtgaagtcccgcatcaccatcaac
cccgacaccagcaagaaccagttctccctgcagctgaacagcgtgacccccgaggacaccgccgtgtactactg
cgcccgcggctacagcagcagcttcgactactggggccagggcaccctggtcaccgtgtccagc CD3L197 LC amino acid sequence (SEQ ID NO: 677):
QSALTQPASVSGSPGQSITISCTGTSSNIGTYKFVSWYQQHPGKAPKVMIYEVSKRPSGVSNRFSGSKSGNTAS
LTISGLQAEDEADYYCVSYAGSGTLLFGGGTKLTVLGQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPTECS CD3L197 LC nucleic acid sequence (SEQ ID NO: 715):
Cagtctgctctgacccagcctgcctccgtgtctggctctcccggccagtccatcaccatcagctgtaccggcac
ctcctccaacatcggcacctacaagttcgtgtcctggtatcagcagcaccccggcaaggccccaaagtgatga
tctacgaggtgtccaagcggccctccggcgtgtccaacagattctccggctccaagtccggcaacaccgcctcc
ctgacaatcagcggactgcaggccgaggacgaggccgactactactgtgtgtcctacgccggctctggcaccct
gctgtttggcggcggaacaaagctgaccgtgctg VH amino acid sequence of CD3H231 (SEQ ID NO: 657):
qvqlqqsgpglvkpsqtlsltcaisgdsvfnnnaawswirqspsrglewlgrtyyrskwlydyavsvksritin
pdtsknqfslqlnsvtpedtavyycargysssfdywgqgtlvtvss VL amino acid sequence of CD3L197 (SEQ ID NO: 678):
QSALTQPASVSGSPGQSITISCTGTSSNIGTYKFVSWYQQHPGKAPKVMIYEVSKRPSGVSNRFSGSKSGNTAS
LTISGLQAEDEADYYCVSYAGSGTLLFGGGTKLTVL HCDR1 of CD3H231 (SEQ ID NO: 662): NNNAAWS HCDR2 of CD3H231 (SEQ ID NO: 663): RTYYRSKWLYDYAVSVKS HCDR3 of CD3H231 (SEQ ID NO: 664): GYSSSFDY LCDR1 of CD3L197 (SEQ ID NO: 671): TGTSSNIGTYKFVS LCDR2 of CD3L197 (SEQ ID NO: 673): EVSKRPS LCDR3 of CD3L197 (SEQ ID NO: 690): VSYAGSGTLL

TABLE 10

Engineered variants of BLW-2E6 LC by C91 scanning

| C91 scanning | peptide ID |
|---|---|
| CD3 2E6 LC | CD3L124 |
| CD3 2E6 LC, C91S | CD3L146 |
| CD3 2E6 LC, C91G | CD3L147 |
| CD3 2E6 LC, C91E | CD3L148 |
| CD3 2E6 LC, C91D | CD3L149 |
| CD3 2E6 LC, C91V | CD3L150 |
| CD3 2E6 LC, C91A | CD3L151 |
| CD3 2E6 LC, C91R | CD3L152 |
| CD3 2E6 LC, C91K | CD3L153 |
| CD3 2E6 LC, C91N | CD3L154 |

TABLE 10-continued

Engineered variants of BLW-2E6 LC by C91 scanning

| C91 scanning | peptide ID |
|---|---|
| CD3 2E6 LC, C91M | CD3L155 |
| CD3 2E6 LC, C91I | CD3L156 |
| CD3 2E6 LC, C91T | CD3L157 |
| CD3 2E6 LC, C91W | CD3L158 |
| CD3 2E6 LC, C91Y | CD3L159 |
| CD3 2E6 LC, C91L | CD3L160 |
| CD3 2E6 LC, C91F | CD3L161 |
| CD3 2E6 LC, C91Q | CD3L162 |
| CD3 2E6 LC, C91H | CD3L163 |
| CD3 2E6 LC, C91P | CD3L164 |

1-8 Binding of BLW-2E6 CD3 mAbs to hCD3E Construct by ProteOn SPR

The binding of BLW-2E6 anti-CD3 mAbs with point mutations on the light and/or heavy chain(s) to a recombinant human CD3ε(1-27) peptide with a C-terminal Tencon25 fusion (Janssen production, referred as hCD3ε(1-27)-Tn25) was measured by ProteOn SPR (Bio-Rad). Goat anti-human Fc IgG (Jackson Immunoresearch, Cat #109-005-098) was directly immobilized via amine coupling at 30 μg/mL in acetate buffer, pH 5.0 on all 6 ligand channels in vertical orientation on GLC Sensor Chip (Bio-Rad, catalog no. 176-5011) with a flow rate of 30 μL/min in PBS containing 0.005% Tween-20. The immobilization densities averaged about 6000 Response Units (RU) with less than 5% variation among different channels. Five different mAbs were captured on the anti-human Fc IgG surface at 1.5 ug/ml (1000-1250 RU) in vertical ligand orientation, with the 6th ligand channel as no ligand surface control. The hCD3ε(1-27)-Tn25 at 1 μM concentration in 3-fold dilution series of 5 concentrations flew in as analyte to bind to captured mAbs in the horizontal orientation. A 6$^{th}$ buffer sample was also injected to monitor the dissociation of captured mAb and baseline stability. The dissociation phase for all concentrations of hCD3ε(1-27)-Tn25 was monitored at a flow rate of 100 μL/min for 30 minutes. The binding surface was regenerated for the next interaction cycle using a 18 second pulse of 0.8% phosphoric acid to remove the antigen and the bound mAb. The raw data were processed by subtracting two sets of reference data from the response data: 1) the inter-spot signals to correct for the non-specific interactions between the Ag and the empty chip surface; 2) the buffer channel signals to correct for baseline drifting due to the dissociation of captured mAb surface over time. The processed data at all concentrations for each mAb were globally fit to a 1:1 simple Langmuir binding model to extract estimates of the kinetic ($k_{on}$, $k_{off}$) and affinity ($K_D$) constants. Results are provided in FIG. 11.

TABLE 11

Summary of the kinetics/affinities of BLW-2E6 variants binding to hCD3ε(1-27)-Tn25 (N = 1)

| Protein AA ID | Heavy Chain | Light Chain | ka (1/Ms) | kd (1/s) | KD (nM) | HC Mutation(s) | LC mutation(s) |
|---|---|---|---|---|---|---|---|
| C3B312 | CD3H219 | CD3L124 | 9.08E+04 | 1.87E-03 | 20.6 | Wild type | Wild type |
| CD3B376 | CD3H219 | CD3L150 | 1.02E+05 | 2.37E-03 | 23.3 | Wild type | C91V |
| N/A | CD3H219 | CD3L160 | 9.84E+04 | 4.05E-03 | 41.1 | Wild type | C91L |
| N/A | CD3H219 | CD3L137 | 6.13E+04 | 2.02E-03 | 32.9 | Wild type | D43G/L49M/L50I/S62N/Q85E/H89Y |
| CD3B334 | CD3H231 | CD3L137 | 6.96E+04 | 5.54E-03 | 79.6 | R10G/R13K/V73I/R79K/T83S/L96V | D43G/L49M/L50I/S62N/Q85E/H89Y |

N/A = not assigned 1-9 Binding of Anti-CD3 Monoclonal Antibodies to Human T Cells In vitro binding affinity of CD3B376 and CD3B450 to human T cells was determined by flow cytometry after crossing with antigen specific target arm. A preliminary study was carried out on human T cells to determine the saturation binding constant of an anti-CD3 tracer molecule (KdT). A fixed concentration of the tracer ([T]) was then used in a competition binding assay with titrated concentrations of the test mAbs. The IC50 (concentration at which 50% inhibition is achieved) value of the test molecule was used to determine the binding affinity ($K_d$) using the following formula: $K_d$=IC50/(1+([T]/$K_d$T)). Five human donors were used to determine the saturation binding constant ($K_d$T) of the tracer, a commercially available AlexaFluor488 SP34-2 anti-CD3 (BioScience #557705) (data not shown).

Determining Saturation Binding Constant of Tracer ($K_d$T)

Methods: Human pan T cells were cryogenically-stored in nitrogen tanks until used. T cells were thawed, washed with PBS, re-suspended in FACS Staining buffer, counted (with viability noted), and re-suspended at 0.5×10^6 cells/mL. Far Red Live/Dead stain (Life Technologies, AKA Invitrogen #L34974) (50 μL of DMSO into a vial) was added at 1 μL per 1×10^6 cells; and FcR blocker (Miltenyi Biotec #130-059-901) (1 mL of a 1:20 dilution per 0.5×10^6 cells) were added to the cells for 10 minutes each. Cells were plated at 50,000 cells/well and washed. Increasing concentrations of the AlexaFluor488 SP-34 anti-CD3 were added to the T cells for 2 hours at 4° C. Cells were washed to remove un-bound antibody, fixed for 15 minutes, washed, and re-suspended in FACS Staining buffer containing 1 mM EDTA.

The iQue Intellicyte Flow Cytometer was used to measure binding. Cells were gated for T cell population, followed by cell singlets, followed by Live Cells (FL4). Geometric mean of staining (FL1) was determined for each well.

The acquired mean fluorescence intensity values were plotted as a function of the antibody molecule concentration and analyzed using Prism software in a one-site binding analysis (Total Binding) (FIG. 9). The software calculates the corresponding $K_d$ value that describes the binding of the antibody molecule to a receptor (the CD3 on Human Pan T cells) that follows the law of mass action. The formula is as follows: $Y=(B_{max} \times X)/(K_d+X)$; where: Bmax is maximal binding; $K_d$ is the concentration of ligand required to reach half-maximal binding.

Results: $K_d$ values were derived for each donor, and the mean value obtained. The Saturation Binding Constant ($K_dT$) for human T-Cells was derived to be 5.6±1.0 nM (n=4) and was used in the previously mentioned formula to determine $K_d$ binding affinities.

Determining Binding Affinity of Anti-CD3 mAbs by Competition Assay

Methods: Competition binding studies were performed using bivalent antibodies against CD3:

Anti CD3 Bivalents: CD3B376 and CD3B450 (FIG. 10)

Human pan T cells were used to determine the binding affinity of the test mAbs. The tracer used was the commercially available AlexaFluor488 SP-34 anti-CD3 (BioScience #557705) and the saturation binding constant for this tracer is described above.

T cells were cryogenically-stored in nitrogen tanks until used. T cells were thawed, washed with PBS, re-suspended in FACS Staining buffer, counted with viability noted, and re-suspended at $0.5 \times 10^6$ cells/mL. Far Red Live/Dead stain (Life Technologies, AKA Invitrogen #L34974) (50 μL of DMSO into a vial) was added at 1 μL per $1 \times 10^6$ cells; and FcR blocker (Miltenyi Biotec #130-059-901) (1 mL of a 1:20 dilution per $0.5 \times 10^6$ cells) was added to the cells for 10 minutes each. Cells were plated at 50,000 cells/well and washed.

The mAbs (and isotype control), were serially diluted 1:2 from a starting concentration of 1000 or 200 μg/mL (2×), and a fixed concentration of the tracer (5 μg/mL; 2×) was mixed together to give 1× concentrations. Therefore, the final (1×) concentration of the tracer was 2.5 μg/mL=16.6 nM. The mixture was added to the T cells for 2 hours at 4° C. Cells were then washed to remove un-bound antibody, fixed for 15 minutes, washed, and re-suspended in FACS Staining buffer containing 1 mM EDTA.

The iQue Intellicyte Flow Cytometer was used to measure binding. Cells were gated for T-cell population, followed by cell singlets, followed by Live Cells (FL4). Geometric mean of staining (FL1) was determined for each well. The acquired mean fluorescence intensity values were plotted as a function of the log antibody molecule concentration (converted to nM) and analyzed using Prism software in a sigmoidal dose-response (variable slope) from which the EC50/IC50 values (in nM) are derived. The binding affinity ($K_d$) was derived using the following formula: $K_d=IC50/(1+([T]/K_dT))$. Where: $K_d$ is the affinity of the competitor (unlabeled molecule); IC50 in nM of the test compound; [T] is concentration of the tracer (16.6 nM); $K_dT$ is the $K_d$ of the tracer determined by saturation binding (5.6 nM for human).

Production of Monoclonal and Bispecific Antibodies

The bispecific CD3 antibodies of the present invention may be generated through controlled Fab-arm exchanged (FAE) as described in Labrijn et al., 2013, PNAS, vol. 110(13): 5145-5150; PCT Publ. WO 2011/131746; or in Labrijn et al., 2014, Nat Protoc, 9(10):2450-63. Briefly, in this in vitro method, two full-length parental bivalent antibodies are provided, each comprising a mutation in the antibody CH3 region that favors heterodimer formation resulting in bispecific antibodies containing a half-arm from each parental antibody. Mutations that may be used to favor heterodimer formation are F405L in one parental antibody and R409K in the other prental antibody for IgG1 antibodies, or F405L and K409R one parental antibody while retaining wild-type CH3 for IgG4 antibodies.

The monospecific antibodies were expressed in HEK cell lines under CMV promoters.

The parental antibodies were purified using a protein A column with an elution buffer of 100 mM NaAc pH3.5 and a neutralization puffer of 2M Tris pH 7.5 and 150 mM NaCl. The mabs were desalted using PD10 (Sephadex G25M) column and dialyzed into D-PBS, pH 7.2 buffer.

Post purification the parental antibodies were mixed under reducing conditions in 75 mM cystamine-HCl and incubated at 31° C. for 4h. The recombination reactions were based on molar ratios, where a set amount of target parent (eg, 10 mg, or ~71.8 nanomoles) was combined with CD3 antibody (eg, ~67.8 nanomoles), where the target parent antibody was added in a 6% excess of the CD3 antibody. The recombinations were subsequently dialyzed against PBS to remove the reductant. The bispecific antibody reactions were performed with an excess of the target parent antibody (ratio) to minimize the amount of unreacted CD3 parental antibody remaining after recombination. Following the partial reduction of the parental mAbs, the reductant was removed via overnight dialysis into PBS.

Results: FIG. 10 shows the inhibition curves for the bivalent and monovalent anti CD3 constructs, CD3B376 and CD3B450, competing for binding against the AlexaFluor488 SP-34 anti CD3 tracer antibody. Increasing concentrations of the test anti CD3 antibodies decreased the binding of the AlexaFluor488 tracer antibody, thus decreasing the mean fluorescence intensity (MFI). IC50 values were generated, and using the aforementioned formula, $K_d$ affinities were calculated and summarized in Table 13.

The CD3B376 binding site was tighter than the CD3B450 in both bivalent and monovalent form.

TABLE 13

IC50 and $K_d$ affinity values of the anti CD3 bivalent and monovalent CD3B376 and CD3B450 constructs

| Construct | anti CD3 | IC50 (nM) | $K_d$ (nM) |
| --- | --- | --- | --- |
| Bivalent | CD3B376 | 29 | 7.3 |
|  | CD3B450 | 60 | 15 |
| Monovalent Construct | CD3B376 | 409 | 103 |
|  | CD3B450 | 1011 | 254 |

1-10 Conformational Stability of Anti-CD3 Monoclonal Antibodies

Conformational stability of the anti-CD3 antibodies CD3B376, CD3B389 (IgG1 sigma version of CD3B376; heavy chain is SEQ ID NO: 729; light chain is SEQ ID NO: 676), CD3B450, and CD3B467 (IgG1 sigma version of CD3B450; heavy chain is SEQ ID NO: 728; light chain is SEQ ID NO: 677) was determined by differential scanning calorimetry (DSC). The mid-point of thermal transition, Tm, was determined from the thermal denaturation profiles of each of the Ab candidates. FIG. 12A-FIG. 12E show the thermal denaturation profiles of the anti-CD3 antibodies in PBS. Table 14 includes a summary of the Tm and the enthalpy values (ΔH) for the thermal unfolding of the anti-CD3 antibodies as determined by DSC.

The DSC results indicate that all anti-CD3 antibodies CD3B376, CD3B389, CD3B450, and CD3B467 have folded domains. Based on the onset of unfolding, the relative stability of each antibody was as follows: CD3B389<CD3B467<CD3B376<CD3B450. The anti-CD3 molecules tested by DSC displayed some differences in their thermal stability. The CD3B376 (IgG4 PAA) molecule displayed three partially unresolved transitions at 59.7, 62.4 and 69.2° C. with a total enthalpy of unfolding of 417.6 kcal/mol, while the CD3B450 (IgG4 PAA) molecule displayed two unresolved transitions at 62.5 and 66.3° C. with a total enthalpy of unfolding of 545.1 kcal/mol. The CD3B389 (IgG1sigma) molecule displayed four transitions at 54.6, 58.2, 73.1 and 77.1° C. with a total enthalpy of unfolding of 401.7 kcal/mol, while the CD3B467 (IgG1sigma) molecule displayed four transitions at 56.3, 59.6, 66.5 and 75.6° C. with a total enthalpy of unfolding of 406.2 kcal/mol.

CD3B334 bound residues 1-6 of CD3e. The N-terminal Gln of the peptide was in the pyroglutamate form and in a hydrophobic environment, between F107 of HCDR3 and L99 of LCDR3. Two arginine residues, R52 and R56, from HCDR2 were engaged in electrostatic interactions with the acidic residues of CD3. In total, 16 residues formed the CD3B334 paratope. Residues from all CDRs except LCDR2 were in direct contact (within 4 Å distance) with the CD3 peptide (see FIG. 18).

2 PSMA Antibodies
2-1 Generation of PSMA Cell Lines

Expression vectors presenting full-length chimpanzee PSMA (H2Q3K5_PANTR, SEQ ID NO: 49) or full length Cynomolgous monkey PSMA (EHH56646.1, SEQ ID NO: 50) were generated for use as screening tools to assess the anti-PSMA leads using an in-house expression vector with

TABLE 14

Summary of the thermal transition data for the anti-CD3 antibodies in PBS. Values represent averages of duplicate runs. Sequence information is provided for HC and LC peptides (SEQ ID NOs in parentheses).

| | CD3B376 HC: SEQ ID NO: 640 LC: SEQ ID NO: 676 | | CD3B450 HC: SEQ ID NO: 675 LC: SEQ ID NO: 677 | | CD3B389 HC: SEQ ID NO: 729 LC: SEQ ID NO: 676 | | CD3B467 HC: SEQ ID NO: 728 LC: SEQ ID NO: 677 | |
|---|---|---|---|---|---|---|---|---|
| | Average | Error | Average | Error | Average | Error | Average | Error |
| Tm1 (° C.) | 59.7 | 0.1 | 62.5 | 0.9 | 54.6 | 0.1 | 56.3 | 0.1 |
| ΔH1 (cal/mol) | 151900.0 | 4200.0 | 158175.0 | 64025.0 | 166150.0 | 2450.0 | 98160.0 | 17840.0 |
| Tm2 (° C.) | 62.4 | 0.1 | 66.3 | 0.2 | 58.2 | 0.1 | 59.6 | 0.0 |
| ΔH2 (cal/mol) | 202200.0 | 4300.0 | 386900.0 | 71000.0 | 62050.0 | 1290.0 | 72900.0 | 370.0 |
| Tm3 (° C.) | 69.2 | 0.0 | NA | NA | 73.5 | 0.1 | 66.5 | 0.0 |
| ΔH3 (cal/mol) | 63450.0 | 2080.0 | NA | NA | 101900.0 | 1600.0 | 92785.0 | 6785.0 |
| Tm4 (° C.) | NA | NA | NA | NA | 77.1 | 0.0 | 75.6 | 0.1 |
| ΔH3 (cal/mol) | NA | NA | NA | NA | 71560.0 | 2500.0 | 142400.0 | 4800.0 |
| Total ΔH | 601000.0 | NA | 545075.0 | NA | 401660.0 | NA | 406245.0 | NA |

The two IgG1 antibodies display lower stability compared to the corresponding IgG4 PAA antibodies (comparing the molecules with the same variable domains) with Tm of the first transition being 5-6° C. lower (FIG. 13A and FIG. 13B and Table 14).

1-11 Crystal Structure of CD3B334 Fab in Complex with CD3e N-Terminal Peptide

Anti-CD3 mAb CD3B334 (CD3H231/CD3L137) was modified to increase the "humanness" index by replacing a number of framework residues in the antibody by the human germline residues. This procedure yielded antibody CD3B334 with the following mutations: D43G/L49M/L50I/S62N/Q85E/H89Y in VL when compared to the parental VL CD3L124 and R10G/R13K/V73I/R79K/T83S/L96V in VH when compared to the paretal VH CD3H219. The His-tagged Fab fragment of CD3B334 was expressed in HEK 293Expi cells and purified using affinity and size-exclusion chromatography. The N-terminal 9-mer peptide of human CD3e was synthesized at New England Peptide (Lot V1108-19/21) and mixed with Fab at molar ratio 10:1 (excess of peptide). The complex was crystallized by the vapor-diffusion method from solution containing 4 M Na formate in 0.1 M Tris, pH 8.5. The crystals belong to the orthorhombic space group P212121 with unit cell dimensions of 66.5× 69.4×100.4 Å and one complex molecule in the asymmetric unit. The structure of the complex was determined at 1.8 Å resolution by the molecular replacement method using the crystal structure of the Fab as a search model.

the CMV promoter using standard molecular biology techniques. Vectors were transiently transfected into HEK293F cells in suspension using standard methods. Transfected 293F suspension cells were plated in growth medium plus serum to become adherent and selected for stable plasmid integration. Single cell populations were selected by serial dilution and the PSMA surface receptor expression was quantified by FACS using the (PSMAL antibody (Center) affinity Purified Rabbit Polycolonal Antibody (Catalog #OAAB02483, Aviva Systems Biology) as the primary antibody with a R-PE anti-rabbit secondary antibody (Catalog #111-116-144, Jackson ImmunoResearch Laboratories, Inc.) and a rabbit polyclonal IgG (Catalog #SC-532, Santa Cruz Biotechnology) as the isotype control).

Human PSMA expressing cell lines were generated using lentivirus (Genecopoeia, cat #EX-G0050-Lv105-10) containing full length human PSMA (FOLH1_HUMAN, SEQ ID NO:51) and puromycin for selection of PSMA positive cells. HEK293F cells (ATCC), negative for PSMA, were transduced with Lentiviral particles to overexpress human PSMA. Following transduction, cells positively expressing PSMA and the resistance marker were selected by treating pooled cells, grown in DMEM+10% HI FBS (Life Technologies) and supplemented with varying concentrations of Puromycin (Life Technologies).

In addition to the HEK generated cell lines, several commercial cell lines were used for phage panning and binding and cellular toxicity assays. LNCaP clone FGC cells (ATCC cat #CRL-1740) are a commercially available human prostate cancer cell lines. C4-2B cells were originally developed at MD Anderson and are derived from LNCaP FGC grown in vivo and metastasize to bone marrow (Thalmann, et al 1994, Cancer Research 54, 2577-81).

2-2 Generation of Soluble PSMA ECD Proteins

Recombinant chimpanzee PSMA Extra Cellular Domain (ECD) protein (Chimp PSMA ECD, SEQ ID NO:52) was generated for panning and to assess the anti-PSMA leads using an in-house expression vector with the CMV promoter using standard molecular biology techniques. The chimp PSMA ECD gene fragment (amino acid 44-750 of SEQ ID NO:49) with N-terminal signal sequence (SEQ ID NO:594), N-terminal Avitag (SEQ ID NO:595) and 6-His tags (SEQ ID NO:596) was cloned using an in-house expression vector with the CMV promoter using standard molecular biology techniques and transiently expressed in 293Expi cells (Invitrogen). cDNA was prepared using gene synthesis techniques (U.S. Pat. Nos. 6,670,127; 6,521,427). Supernatants were harvested and clarified by centrifugation. The proteins were purified using a two-step purification process: 1) IMAC purification with a HisTrap HP column (GE Healthcare) and 2) size exclusion purification (Superdex 200, Ge Healthcare) where the elution buffer is Dulbecco's phosphate-buffered saline, calcium, magnesium (Thermofisher, #14040) containing 0.5 mM $ZnCl_2$ to stabilize PSMA dimerization. Fractions containing the protein of interest were pooled and protein concentration was determined by A280. This material was used for binding and affinity measurements and is referred to as PSMG8.

Chimp PSMA ECD was also biotinylated for panning. The BirA plasmid that was co-transfected into mammalian cells to biotinylate proteins containing the Avi tag was created in-house. The BirA coding region (SEQ ID NO:597) was fused to the signal peptide from mouse IgG heavy chain (SEQ ID NO:598), and an ER retention signal (KDEL (SEQ ID NO: 716)) was added to the C-terminus to generate the BirA plasmid (SEQ ID NO:599). The constructed gene was cloned into an expression vector under the control of the CMV promoter. To produce biotinylated PSMA antigen, the PSMA plasmid DNA was added in a 4-fold excess (w/w) to the BirA plasmid into the transfection mix.

Biotinylation of the Chimp PSMA ECD protein was performed via the Avi tag by cotransfection of a BirA expression construct and the resulting secreted protein was purified using a two-step purification process: 1) IMAC purification with a HisTrap HP column (GE Healthcare) and 2) size exclusion purification (Superdex 200, Ge Healthcare) where the elution buffer is Dulbecco's phosphate-buffered saline, calcium, magnesium (Thermofisher, #14040) containing 0.5 mM $ZnCl_2$ to stabilize PSMA dimerization. The protein was tested for endotoxin prior to use in phage panning studies.

Recombinant cynomolgous monkey PSMA extracellular domain (ECD) protein (cyno PSMA ECD, SEQ ID NO:53), corresponding to amino acids 44-750 of SEQ ID NO:50 with N-terminal signal (SEQ ID NO:594), N-terminal Avi- (SEQ ID NO:595) and 6His- (SEQ ID NO:596) tags was cloned and expressed as described previously for the chimp PSMA ECD. Biotinylation of the cyno PSMA ECD protein was performed via the Avi tag by cotransfection of a BirA expression construct and the resulting secreted protein was purified by a two-step purification using IMAC HisTrap HP column (GE Healthcare) and MonoAvidin columns. The protein was tested for endotoxin prior to use in phage panning studies. This material was also used for binding and affinity measurements and is referred to as PSMG1.

A second recombinant cyno PSMA ECD protein (Cyno PSMA Fc, SEQ ID NO:54) with an IgG1 Fc (SEQ ID NO:593) was cloned and expressed using an in-house expression vector with the CMV promoter using standard molecular biology techniques. CynoPSMA Fc protein was transiently expressed in 293HEK-expi cells. Transient transfection of PSMG3 in HEK293 Expi cells were harvested 5 days after transfection, clarified by centrifugation (30 min, 6000 rpm) and filtered (0.2µ PES membrane, Corning). The relative amount of IgG was determined with the Octet instrument (ForteBio) using a purified known IgG (same isotype) spiked into spent medium to generate the standard curve.

Clarified Cyno PSMA Fc supernatant was loaded onto an equilibrated (dPBS, pH 7.2) HiTrap MabSelect Sure Protein A column (GE Healthcare) at a relative concentration of ~30 mg protein per ml of resin. After loading, the column was washed with dPBS, pH7.2 and protein eluted with 10 column volumes of 0.1 M Na-Acetate, pH 3.5. Peak fractions were pooled, neutralized with 2M Tris, pH 7, and filtered (0.2µ). The neutralized protein sample was dialyzed against 3 changes of dPBS containing Ca2+, Mg2+, and 0.5 mM $ZnCl_2$, pH 7.2 overnight at 4° C. The next day, sample was removed from dialysis, filtered (0.2µ) and the protein concentration determined by absorbance at 280 nm on a BioTek SynergyHTTM spectrophotometer. The quality of the purified proteins was assessed by SDS-PAGE and analytical size exclusion HPLC (Dionex HPLC system). Endotoxin levels were measured using a LAL assay (Pyrotell-T, Associates of Cape Cod). Purified proteins were stored at 4° C.

Recombinant human PSMA extracellular domain (ECD) protein (human PSMA ECD, SEQ ID NO:55), corresponding to amino acids 44-750 of SEQ ID NO:51 with N-terminal Avi- and 6His tags (SEQ ID NO: 596) was cloned, expressed and purified as described previously for the chimp and cyno PSMA ECD proteins.

2-3 Identification of Anti-Chimp and Anti-Human PSMA Fabs

Panning with Recombinant Protein

A first solution panning of the de novo Human Fab-pIX libraries [Shi, L., et al J Mol Biol, 2010. 397(2): p. 385-396. WO 2009/085462], consisting of VH1-69, 3-23 and 5-51 heavy chain libraries paired with four human VL germline genes (A27, B3, L6, O12) libraries, was performed using an alternating panning approach with one round of phage capture on Strepavidin beads (Invitrogen Cat #112.05D, Lot #62992920) coated with biotinylated Chimp PSMA ECD according to the manufacturer's protocol, followed by phage capture on ProtG beads (Invitrogen, Cat #10003D) coated with Cyno-PSMA-Fc according to the manufacturer's protocol followed by phage capture on Sera-mag Double Speed magnetic Neutravidin beads (Thermo, Cat #7815-2104-011150) coated with biotinylated Chimp PSMA ECD according to the manufacturer's protocol. This panning yielded two hits: PSMM18 and PSMM25.

Whole Cell Panning for Anti-PSMA Fabs

Additional panning experiments were performed on whole cells using the Round #1 output from the chimpanzee ECD panning experiments described above or fresh de novo phage libraries, as input. Briefly, phage was produced by helper phage infection and concentrated by PEG/NaCl precipitation according to standard protocols known in the art. The phage libraries were pre-cleared on untransfected parental HEK293F cells overnight at 4° C. with gentle rocking. Following PEG/NaCl precipitation, the pre-cleared libraries were incubated with chimp PSMA expressing HEK293 cells or LNCAP cells with gentle rocking for 2 hr at 4° C. The removal of unbound phage and the recovery of phage-bound cells was performed by Ficoll gradient, and following several wash steps with, cells carrying bound phage were incubated with 1 mL of TG-1 E. coli culture at 37° C. for 30 minutes without agitation. The resulting mixture was plated on LB-Carbenicillin-1% Glucose plates and grown over night at 37° C. The process was then repeated for subsequent panning rounds.

Conversion of Phage Fab-pIX to Fab-his for Generating E. coli Supernatants

The resulting phage Fab-pIX hits were converted to Fab-His using a standard procedure. Plasmid DNA was isolated from phage panned E. coli (Plasmid Plus Maxi Kit, Qiagen cat #12963) and subjected to NheI/SpeI restriction digest. The resulting 5400 and 100 bp fragments were separated on a 0.8% agarose gel and the 5400 bp fragment was gel purified (MinElute PCR purification kit, Qiagen cat #28006). The purified 5400 bp band was self-ligated using T4 ligase and the resulting product (encoding the Fab-his fusion) was transformed back into the TG-1 E. coli strain and clonally isolated. Fab-His supernatants were generated from clones by overnight induction of cultures with 1 mM IPTG. Following centrifugation of the overnight culture, clarified supernatants were ready for use in downstream assays. To determine the relative expression levels of different Fab-his supernatants, an anti-kappa (Southern Biotech cat #2061-05) ELISA on serially diluted supernatants was performed. All of the clones tested exhibited similar Fab-his expression (data not shown).

Cell Binding of Fab-his Fusions from E. coli

A cell-based binding assay was designed to assess the binding capabilities of individual Fab-his fusions from E. coli supernatants to PSMA-expressing cells. Individual Fab clones were isolated from the round 3 output of all panning experiments following pIX excision. Fab clones were tested for binding to chimp and cyno PSMA expressing HEK cells, as well as to human PSMA on LNCaP cells. Briefly, PSMA expressing cells were aliquoted into a V-bottom plate (Co-Star 3357) at a density of 200,000 per well and incubated with (100 µl) supernatants expressing Fab fragments for 1 hour on ice. Cells were washed twice with PBS containing 2% FBS, and stained with a mouse anti-human kappa-RPE antibody (Life Technologies cat #MH10514) for 1 hour on ice. Cells were washed twice with PBS containing 2% FBS and resuspended in 100 µL of the same wash buffer. Plates were read on a BD FACS Array flow cytometer. FACS data was analyzed in FlowJo software by live gating the healthy population of cells using forward scatter and side scatter, and then analyzing the cells within this gate for PE staining. Mean fluorescence intensity (MFI) was calculated and exported into Microsoft Excel. Fab clones that exhibited binding ≥3 times background for all three species of PSMA (cyno, chimp and human), and exhibited no binding to the HEK293 cell line, were labeled as "preliminary positive". Fabs were sequenced and moved forward for cloning into mammalian expression vector for rescreening. True positives were selected from the binding of mammalian cell expressed Fab supernatants to PSMA-expressing cell lines.

Preparation of Mammalian Fabs

For conversion of E. coli Fab to mammalian-expressed Fab, In-Fusion HD cloning (ClonTech cat #638918) was utilized according to the manufacturer's protocol. Briefly, nucleotide sequences of clones that have passed the primary screen and are to be moved into mammalian Fab format, are loaded into the "InFu Primer Finder v1.2.3" program (software developed in-house), which generates a list of isotype-specific PCR primers used to generate PCR fragments for In-Fusion cloning into the huKappa_muIgGSP and huG1 Fab expression vectors. These vectors are in-house vectors with CMV promotors based off of pcDNA3.1. Following the In-fusion process, E. coli clones were isolated, sequence verified and transfected into HEK293 cells using standard protocols. Mammalian PSMA Fabs for confirming binding to PSMA expressing cell lines were prepared by harvesting 20 ml of supernatants from transfection after 5 days.

Rescreening Hits from Whole Cell Panning in Mammalian Sup Format

Confirmation of mammalian expressed Fab supernatants was performed using the whole cell binding assay described previously. Binding of Fabs to human PSMA (LNCaP), chimpanzee, and cynomolgous monkey cells was tested, as well as counter screening for no binding to the parental HEK cell line. Table 19 shows the hit profile of mammalian Fab supernatant binding to PSMA-expressing cells. Many of the hits from E. coli supernatants did not confirm with mammalian expressed proteins. PSMM48 showed high binding to cyno PSMA-expressing cells and some binding to chimp-PSMA expressing cells, but no binding to LNCaP cells expressing human PSMA. PSMM56 showed a similar profile, but with some binding to LNCaP cells. PSMM69—80 bound to LNCaP cells, but not to chimp- or cyno-PSMA expressing cells. Mammalian Fab sups PSM152, M56 and M57, bound all three cell lines. PSMMN50, M51, and M54, show more chimp or cyno binding. M58 showed slight chimp and cyno binding.

TABLE 19

Hit profile of Mammalian Fab protein binding to PSMA-expressing cells measured by Geo-MFI (Mean Fluoresent Instensity)

| Fab ID (Fab DNA ID) | cyno | chimp | LNCaP | Parent HEK |
|---|---|---|---|---|
| PSMB10 (PSMM10) | 244 | 81.6 | — | 248 |
| PSMB11 (PSMM11) | 19 | 6.6 | — | 8.14 |
| PSMB12 (PSMM12) | 31.6 | 8.05 | — | 12.6 |
| PSMB13 (PSMM13) | 57.8 | 18.2 | — | 50.5 |
| PSMB14 (PSMM14) | 32.6 | 13.1 | — | 22.2 |
| PSMB15 (PSMM15) | 40.4 | 18.5 | — | 38 |
| PSMB16 (PSMM16) | 175 | 220 | — | 6.39 |
| PSMB17 (PSMM17) | 34.9 | 22.4 | — | 40.1 |
| PSMB18 (PSMM18) | 696 | 439 | — | 8.71 |
| PSMB19 (PSMM19) | 53.7 | — | 5.15 | 4.47 |
| PSMB20 (PSMM20) | 5.75 | — | 5.85 | 41.3 |
| PSMB21 (PSMM21) | 94.4 | — | 20.7 | 372 |
| PSMB22 (PSMM22) | 9.07 | — | 7.92 | 54.9 |
| PSMB23 (PSMM23) | 16.4 | — | 6.66 | 164 |
| PSMB24 (PSMM24) | 14.6 | 9.6 | 4.09 | 3.96 |
| PSMB25 (PSMM25) | 15.2 | 11.3 | 16.9 | 4.09 |
| PSMB26 (PSMM26) | 9.48 | — | 7.26 | 114 |
| PSMB27 (PSMM27) | 20 | — | 7.56 | 136 |
| PSMB28 (PSMM28) | 29.7 | — | 8.88 | 302 |
| PSMB29 (PSMM29) | 6.87 | — | 5.7 | 72.8 |
| PSMB30 (PSMM30) | 5.16 | — | 4.58 | 45 |
| PSMB31 (PSMM31) | 5.99 | — | — | 25.5 |
| PSMB32 (PSMM32) | 4.81 | — | — | 27.1 |
| PSMB33 (PSMM33) | 5.14 | — | — | 40.1 |
| PSMB34 (PSMM34) | 17.9 | — | — | 107 |
| PSMB35 (PSMM35) | 58.5 | — | — | 231 |
| PSMB36 (PSMM36) | 5.05 | — | — | 6.96 |
| PSMB37 (PSMM37) | 23.4 | — | — | 178 |
| PSMB38 (PSMM38) | 4.05 | — | — | 7.7 |
| PSMB39 (PSMM39) | 10.2 | — | — | 166 |
| PSMB40 (PSMM40) | 66.9 | — | — | 348 |
| PSMB41 (PSMM41) | 5.39 | — | — | 12 |
| PSMB42 (PSMM42) | 7.35 | — | — | 25.8 |
| PSMB43 (PSMM43) | 8.73 | — | — | 7.18 |
| PSMB44 (PSMM44) | 12.6 | — | — | 48.9 |
| PSMB45 (PSMM45) | 22.4 | — | — | 43.1 |
| PSMB46 (PSMM46) | 3.88 | — | — | 5.29 |

TABLE 19-continued

Hit profile of Mammalian Fab protein binding to PSMA-expressing cells measured by Geo-MFI (Mean Fluoresent Instensity)

| Fab ID (Fab DNA ID) | cyno | chimp | LNCaP | Parent HEK |
|---|---|---|---|---|
| PSMB47 (PSMM48) | 101 | 25.5 | 3.46 | 2.85 |
| PSMB48 (PSMM49) | 2.72 | 3.18 | 2.68 | 2.72 |
| PSMB49 (PSMM50) | 51.6 | 22 | 3.22 | 3.48 |
| PSMB51 (PSMM52) | 285 | 231 | 41.5 | 2.68 |
| PSMB52 (PSMM53) | 39.2 | 6.89 | 2.67 | 2.56 |
| PSMB53 (PSMM54) | 27.6 | 17.8 | 4 | 2.6 |
| PSMB54 (PSMM55) | 2.7 | 2.75 | 2.65 | 2.79 |
| PSMB55 (PSMM56) | 226 | 180 | 17.2 | 2.58 |
| PSMB56 (PSMM57) | 95.6 | 34.7 | 24.5 | 2.52 |
| PSMB57 (PSMM58) | 19.8 | 11 | 3.26 | 2.68 |
| PSMB58 (PSMM59) | 121 | 192 | 25.3 | 2.67 |
| PSMB59 (PSMM60) | 4.96 | 9.69 | 6.04 | 3 |
| PSMB60 (PSMM61) | 2.28 | 3.07 | 87.3 | 4.64 |
| PSMB61 (PSMM62) | 2.1 | 3.16 | 135 | 2.98 |
| PSMB62 (PSMM63) | 7.17 | 4.43 | 54.9 | 9.09 |
| PSMB63 (PSMM64) | 2.07 | 2.95 | 27 | 2.82 |
| PSMB64 (PSMM65) | 2.39 | 3.26 | 70.5 | 3.05 |
| PSMB65 (PSMM66) | 2.3 | 3.13 | 32.4 | 4.25 |
| PSMB66 (PSMM67) | 2.14 | 3 | 24.6 | 2.83 |
| PSMB67 (PSMM68) | 2.23 | 2.95 | 21 | 2.95 |
| PSMB68 (PSMM69) | 5.44 | — | 134 | 35.3 |
| PSMB69 (PSMM70) | 2.29 | 3.38 | 25.5 | 3.35 |
| PSMB70 (PSMM71) | 2.22 | 3.49 | 15.5 | 3.26 |
| PSMB71 (PSMM72) | 2.54 | 4.4 | 18.5 | 3.07 |
| PSMB72 (PSMM73) | 2.13 | 3.53 | 227 | 3.02 |
| PSMB73 (PSMM74) | 2.97 | 4.13 | 125 | 11.1 |
| PSMB74 (PSMM75) | 120 | — | 178 | 132 |
| PSMB75 (PSMM76) | 2.99 | 3.04 | 173 | 7.89 |
| PSMB76 (PSMM77) | 3.75 | 3.99 | 138 | 3.95 |
| PSMB77 (PSMM78) | 4.68 | 3.96 | 144 | 4.71 |
| PSMB78 (PSMM79) | 25.2 | — | 378 | 24.4 |
| PSMB79 (PSMM80) | 38.4 | — | 512 | 157 |
| PSMB80 (PSMM81) | 19.6 | 18.6 | 20.9 | 6.61 |
| PSMB81 (PSMM82) | 2.63 | 2.06 | 4.07 | 2.69 |
| PSMB82 (PSMM83) | 2.79 | 2.23 | 4.11 | 2.76 |
| PSMB83 (PSMM84) | 2.59 | 2.28 | 4.09 | 2.74 |
| PSMB84 (PSMM85) | 750 | 729 | 192 | 3.15 |
| PSMB85 (PSMM86) | 2.84 | 2.59 | 2.33 | 3.24 |
| PSMB86 (PSMM87) | 224 | 176 | 31.7 | 2.82 |
| PSMB87 (PSMM88) | 2.63 | 2.27 | 4.23 | 2.91 |
| PSMB88 (PSMM89) | 37.7 | 29.7 | 30.3 | 7.6 |
| PSMB89 (PSMM90) | 27.1 | 27.3 | 53.2 | 39.5 |
| PSMB90 (PSMM91) | 26.7 | 24.7 | 47.1 | 36.4 |
| PSMB91 (PSMM92) | 8.97 | 6.16 | 13 | 6.63 |
| PSMB92 (PSMM93) | 20 | 16.5 | 57.1 | 50 |
| PSMB93 (PSMM94) | 5.13 | 9.62 | 2.5 | 3.66 |
| PSMB94 (PSMM95) | 5.12 | 2.67 | 2.22 | 3.57 |
| PSMB95 (PSMM96) | 8.9 | 8.82 | 13.4 | 11.4 |
| PSMB96 (PSMM97) | 2.4 | 3.25 | 2.53 | 4.03 |
| PSMB97 (PSMM98) | 2.57 | 4.73 | 2.52 | 3.7 |
| PSMB99 (PSMM100) | 9.95 | 2.4 | 2.39 | 4.03 |
| PSMB100 (PSMM101) | 4.03 | 2.52 | 2.33 | 3.37 |
| PSMB100 (PSMM101) | 3.5 | 2.86 | 2.48 | 4.57 |
| PSMB101 (PSMM102) | 5.49 | 3.18 | 2.23 | 3.33 |
| PSMB102 (PSMM103) | 2.4 | 2.42 | 2.16 | 3.2 |
| PSMB103 (PSMM104) | 3.52 | 3.26 | 2.58 | 4.44 |
| PSMB104 (PSMM105) | 2.15 | 2.5 | 2.34 | 3.95 |
| PSMB105 (PSMM106) | 2.03 | 2.39 | 2.18 | 3.39 |
| PSMB106 (PSMM107) | 2 | 2.4 | 2.27 | 3.59 |
| PSMB107 (PSMM108) | 2 | 2.47 | 2.33 | 3.49 |
| PSMB108 (PSMM109) | 2 | 2.58 | 2.28 | 3.46 |
| PSMB109 (PSMM110) | 321 | 326 | 34.9 | 6.11 |
| PSMB110 (PSMM111) | 2.3 | 2.31 | 2.31 | 3.4 |
| PSMB111 (PSMM112) | 2.32 | 2.31 | — | 3.21 |
| PSMB112 (PSMM113) | 6.28 | 5.7 | 2.71 | 3.28 |
| PSMB113 (PSMM114) | 2.82 | 2.95 | 2.32 | 3.29 |
| PSMB114 (PSMM115) | 2.78 | 2.47 | 4.3 | 3.14 |
| PSMB115 (PSMM116) | 2.66 | 2.59 | 2.2 | 3.14 |
| PSMB46 (PSMM117) | 4.54 | 3.18 | 2.21 | 4.79 |
| PSMB67 (PSMM118) | 3.95 | 4.3 | 3 | 6.13 |
| PSMB74 (PSMM119) | 7.94 | 13 | 3.16 | 12.5 |
| PSMB78 (PSMM120) | 5.08 | 4.79 | 22.3 | 6.82 |
| PSMB81 (PSMM121) | 3.66 | 3.83 | 3.05 | 5.11 |
| PSMB82 (PSMM122) | 15.1 | 28.4 | 10.8 | 24.3 |
| PSMB83 (PSMM123) | 37.5 | 42.1 | 3.04 | 4.88 |
| PSMB85 (PSMM124) | 34.6 | 52.9 | 20.7 | 46.8 |
| PSMB87 (PSMM125) | 4.23 | 3.74 | 2.26 | 4.73 |
| PSMB89 (PSMM126) | 51.8 | 53.1 | 11.7 | 6.27 |
| PSMB90 (PSMM127) | 42.8 | 30.2 | 7.74 | 5.99 |
| PSMB91 (PSMM128) | 3.9 | 27.6 | 2.37 | 4.32 |
| PSMB92 (PSMM129) | 45.7 | 37.3 | 12.1 | 7.4 |
| PSMB93 (PSMM130) | 5.13 | 7.85 | 4.11 | 7.82 |
| PSMB94 (PSMM131) | 3.67 | 3.23 | 2.32 | 4.72 |
| PSMB95 (PSMM132) | 4.05 | 3.64 | 2.56 | 5.57 |
| PSMB96 (PSMM133) | 3.91 | 4.54 | 2.37 | 4.65 |
| PSMB97 (PSMM134) | 3.22 | 3.16 | 4.08 | 4.22 |
| PSMB98 (PSMM135) | 15.6 | 12.7 | 2.22 | 4.21 |
| PSMB99 (PSMM136) | 4.08 | 3.26 | 2.22 | 5.04 |
| PSMB100 (PSMM137) | 5.24 | 3.82 | 2.16 | 4.83 |
| PSMB101 (PSMM138) | 3.84 | 3.14 | 2.23 | 4.52 |
| PSMB102 (PSMM139) | 4.51 | 3.82 | 2.23 | 4.59 |
| PSMB103 (PSMM140) | 6.81 | 4.27 | 2.21 | 5.41 |
| PSMB104 (PSMM141) | 7.52 | 4.35 | 2.26 | 4.39 |
| PSMB105 (PSMM142) | 5.03 | 11.2 | 4.87 | 7.28 |
| PSMB106 (PSMM143) | 3.87 | 3.8 | 2.73 | 4.9 |
| PSMB107 (PSMM144) | 3.3 | 3.35 | 2.3 | 4.64 |
| PSMB108 (PSMM145) | 6.78 | 3.83 | 2.33 | 4.98 |
| PSMB110 (PSMM146) | 4.03 | 3.23 | 2.28 | 5.3 |
| PSMB111 (PSMM147) | 3.71 | 3.26 | 2.36 | 5.11 |
| PSMB112 (PSMM148) | 4.54 | 3.26 | 2.26 | 4.86 |
| PSMB113 (PSMM149) | 84.3 | 104 | 51.7 | 94.2 |
| PSMB114 (PSMM150) | 3.31 | 3.26 | 2.21 | 5.14 |
| PSMB115 (PSMM151) | 3.55 | 3.43 | 2.3 | 4.21 |

Dose Response Curves of Mammalian Expressed Fabs

Once mammalian expressed Fab clones were confirmed for positive binding as neat Fab supernatants to PSMA expressing cell lines, the supernatants were normalized for protein concentration by Octet or protein gel, and dose-response curves were completed to confirm PSMA binding using the protocol described previously. FIG. 22-FIG. 24 show titration curves for hits that demonstrated binding to all three PSMA-expressing cells. FIGS. 22A, 22B, 22C and 22D show the titration curves for anti-PSMA panning hits vs. LNCaP cells. FIGS. 23A, 23B, 23C, and 23D show the titration curves for anti-PSMA panning hits vs chimp-PSMA HEK cells. FIGS. 24A, 24B, 24C, and 24D show the titration curves for anti-PSMA panning hits vs Cyno-PSMA HEK cells. Binding profiles among hits were compared across cell lines expressing different species of PSMA. PSMM52 supernatant was used as a positive control across experiments. Several hits were deprioritized because of N-linked glycosylation sites in CDRs, binding to the PSMA negative parental HEK cell line, or lack of binding to PSMA positive cell lines. Eleven Fab hits remained and 10 hits were cloned into human IgG4-PAA heavy chain constructs and used to generate PSMA×CD3 bispecific antibodies. These hits showed cross-species binding within 3-fold of each other and were moved into a bispecific antibody format to be tested for T cell redirection killing of PSMA positive targets. The panning antigens for each hit is shown in Table 20.

TABLE 20

Antigen for each of the panning hits

| Round 1 antigen | Round 2-3 antigen | Hits | Hit identification |
|---|---|---|---|
| Chimp PSMA ECD | Cyno PSMA ECD | 2 | PSMM18, PSMM25 |
| Chimp PSMA ECD | Chimp PSMA HEK | 9 | PSMM50, PSMM52, PSMM57, PSMM59, |

TABLE 20-continued

Antigen for each of the panning hits

| Round 1 antigen | Round 2-3 antigen | Hits | Hit identification |
|---|---|---|---|
| LNCaP | Chimp PSMA HEK | 2 | PSMM110, PSMM56, PSMM85, PSMM84, PSMM87, PSMM81 |

Preparation of Anti-PSMA mAbs

A total of 12 clones that demonstrated binding to all three PSMA-expressing cells were ultimately converted to mAb IgG4 having Fc substitutions S228P, F234A, and L235A (PAA) isotype by restriction cloning. Briefly, constructs corresponding to Fab clones that have passed initial screens were digested with HindIII and ApaI. Gel purified fragments were ligated into an expression vector with CMV promotervDR000215, a CMV driven expression vector containing the human IgG4-PAA Fc for full mAb expression. This allowed for rapid generation of bispecific antibodies. The expression vector previously described was used to express the Heavy and Light Chains for each PSMA mab, where both vectors were co-transfected transiently into 293Expi or CHO cell lines for expression of the mAb. CDR sequences of cross-species positive PSMA Fabs generated from phage panning are shown below in Table 21. VH and VL sequences of the selected Fabs are shown below in Table 22. Heavy and light chain sequences of mAbs generated from the Fabs are shown in Table 23.

TABLE 21

CDR sequences (defined according to Kabat) of FAbs from phage panning (corresponding SEQ ID NOs are listed in parentheses)

| FAB ID | | | CDR1 | CDR2 | CDR3 |
|---|---|---|---|---|---|
| PSMB109 | HC | | NAWIS (62) | WINPESGRANYAQKFQG (63) | ELYYLVYSTYYYAFDY (64) |
|  | LC | | RASQSIDRWLN (65) | AASSLQS (60) | QQSPRYPLT (66) |
| PSMB86 | HC | | SYDIS (67) | GIIPIEGTANYAQKFQG (68) | DYPAGYGFDY (69) |
|  | LC | | RASQSVSSSYLA (70) | GASSRAT (71) | QQYGSSPLT (72) |
| PSMB84 | HC | | SDWMS (73) | AISGNGGSTEYADSVKG (74) | DPYYYYDGDSYYGMDV (72) |
|  | LC | | RASQSISSYLN (76) | AASSLQS (60) | QQSYSTP (61) |
| PSMB83 | HC | | SDAMH (78) | EISGSGGYTNYADSVKG (79) | DSYDSSLYVGDYFDY (80) |
|  | LC | | RASQSVSSYLA (81) | DASNRAT (82) | QQRSNWPLT (83) |
| PSMB56 | HC | | SYAIS (84) | WISPYNGNANYAQKFQG (85) | DSDRSYNLDY (86) |
|  | LC | | RASQSISGWLN (87) | AASSLQS (60) | QQSYSTPLT (88) |
| PSMB55 | HC | | SYWIG (89) | IIYPGDSDTRYSPSFQG (90) | GLPIWYLDY (91) |
|  | LC | | RASQSVASDLA (92) | FASNRAT (93) | QQSITWPFT (94) |
| PSMB51 | HC | | SYAIS (95) | WIIPYNGNANYAQKFQG (96) | VNSAALVWERLDY (97) |
|  | LC | | RASQSIDRWLN (65) | AASSLQS (60) | QQSPRYPLT (66) |
| PSMB49 | HC | | SYAIS (84) | GIIPIFGTANYAQKFQG (98) | ASRVWHASYGYLDY (99) |
|  | LC | | RASQSVSKWLA (100) | DASNRAT (82) | QQRFTAPWT (101) |
| PSMB25 | HC | | WYWIG (89) | IIYPGDSDTRYSPSFQG (90) | GWAYDRGLDY (102) |
|  | LC | | KSSQSVLYSSNNKNYLA (103) | WASTRES (104) | QQYYSTPLT (105) |
| PSMB18 | HC | | SYWIG (89) | IIYPGDSDTRYSPSFQG (90) | AYHYSKGLDY (106) |
|  | LC | | KSSQSVLYSSNNKNYLA (103) | WASTRES (104) | QQYYSTPLT (105) |

TABLE 21-continued

CDR sequences (defined according to Kabat) of FAbs from phage panning
(corresponding SEQ ID NOs are listed in parentheses)

| FAB ID | | CDR1 | CDR2 | CDR3 |
|---|---|---|---|---|
| PSMB80 | HC | DYAIS (107) | RIDPIEGTANYAQKFQG (108) | DRYYYDGVYWYSDYFDY (109) |
| | LC | RASQSISSYLN (76) | AASSLQS (60) | QQSYSTPLT (88) |
| PSMB58 | HC | SYWIS (56) | IIYPGDSYTRYSPSFQG (57) | DYEWELFDSRLDY (58) |
| | LC | RASQSISSYLN (59) | AASSLQS (60) | QQSYSTP (61) |

TABLE 22

VH and VL sequences of PSMA Fabs

| FAB ID | VH Amino acid sequence | SEQ ID NO | VL Amino Acid Sequence | SEQ ID NO |
|---|---|---|---|---|
| PSMB109 | QVQLVQSGAEVKKPGSSVKVSCKASGGTFSSYAISWVRQAPGQGLEWMGWISPYNGNANYAQKFQGRVTITADESTSTAYMELSSLRSEDTAVYYCARVNSAALVWERLDYWGQGTLVTVSS | 110 | DIQMTQSPSSLSASVGDRVTITCRASQSIDRWLNWYQQKPGKAPKLLIYAASSLQSGVPSRFSGSGSGTDFTLTISSLQPEDFATYYCQQSPRYPLTFGQGTKVEIK | 111 |
| PSMB86 | QVQLVQSGAEVKKPGSSVKVSCKASGGTFKSYDISWVRQAPGQGLEWMGGIIPIEGTANYAQKFQGRVTITADESTSTAYMELSSLRSEDTAVYYCARDYPAGYGFDYWGQGTLVTVSS | 112 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK | 113 |
| PSMB84 | EVQLLESGGGLVQPGGSLRLSCAASGFTFDSDWMSWVRQAPGKGLEWVSAISGNGGSTEYADSVKGRFTISRDNSKNTLYLQMNSLRAEDTAVYYCARDPYYYYDGDSYYGMDVWGQGTLVTVSS | 114 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIK | 115 |
| PSMB83 | EVQLLESGGGLVQPGGSLRLSCAASGFTFKSDAMHWVRQAPGKGLEWVSEISGSGGYTNYADSVKGRFTISRDNSKNTLYLQMNSLRAEDTAVYYCARDSYDSSLYVGDYFDYWGQGTLVTVSS | 116 | EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIK | 117 |
| PSMB80 | QVQLVQSGAEVKKPGSSVKVSCKASGGTFDDYAISWVRQAPGQGLEWMGRIDPIEGTANYAQKFQGRVTITADESTSTAYMELSSLRSEDTAVYYCARDRYYYDGVYWYSDYFDYWGQGTLVTVS | 118 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIK | 119 |
| PSMB58 | EVQLVQSGAEVKKPGESLKISCKGSGYSFTSYWISWVRQMPGKGLEWMGIIYPGDSYTRYSPSFQGQVTISADKSISTAYLQWSSLKASDTAMYYCARDYEWELFDSRLDYWGQGTLVTVSS | 120 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIK | 115 |
| PSMB56 | QVQLVQSGAEVKKPGSSVKVSCKASGGTFSSYAISWVRQAPGQGLEWMGWISPYNGNANYAQKFQGRVTITADESTSTAYMELSSLRSEDTAVYYCARDSDRSYNLDYWGQGTLVTVSS | 121 | DIQMTQSPSSLSASVGDRVTITCRASQSISGWLNWYQQKPGKAPKLLIYAASSLQSGVPSRFSGSGSGTDFTLTISSLQPEDFATYYCQQSYSTPLTFGQGTKVEIK | 122 |

TABLE 22-continued

VH and VL sequences of PSMA Fabs

| FAB ID | VH Amino acid sequence | SEQ ID NO | VL Amino Acid Sequence | SEQ ID NO |
|---|---|---|---|---|
| PSMB55 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGLPIWYLDYWGQGTLVTVSSA | 123 | EIVLTQSPATLSLSPGERATLSCRASQSVASDLAWYQQKPGQAPRLLIYFASNRATGIPARFSGSGSGTDFTLTISSLEPEDFAVYYCQQSITWPFTFGQGTKVEIK | 124 |
| PSMB51 | QVQLVQSGAEVKKPGSSVKVSCKASGGTFSSYAISWVRQAPGQGLEWMGWIIPYNGNANYAQKFQGRVTITADESTSTAYMELSSLRSEDTAVYYCARVNSAALVWERLDYWGQGTLVTVSS | 125 | DIQMTQSPSSLSASVGDRVTITCRASQSIDRWLNWYQQKPGKAPKLLIYAASSLQSGVPSRFSGSGSGTDFTLTISSLQPEDFATYYCQQSPRYPLTFGQGTKVEIK | 111 |
| PSMB49 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARASRVWHASYGYLDYWGQGTLVTVSS | 126 | EIVLTQSPATLSLSPGERATLSCRASQSVSKWLAWYQQKPGQAPRLLIYDASNRATGIPARFSGSGSGTDFTLTISSLEPEDFAVYYCQQRFTAPWTFGQGTKVEIK | 127 |
| PSMB25 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGWAYDRGLDYWGQGTLVTVSS | 128 | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIK | 129 |
| PSMB18 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARAYHYSKGLDYWGQGTLVTVSS | 130 | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIK | 131 |

TABLE 23

Heavy and Light chain sequences of PSMA monoclonal antibodies with corresponding SEQ ID NOs

| mAb ID | Heavy Chain Amino acid sequence | SEQ ID NO | Light Chain Amino Acid Sequence | SEQ ID NO |
|---|---|---|---|---|
| PSMB129 (FAB PSM109) | QVQLVQSGAEVKKPGSSVKVSCKASGGTFSSYAISWVRQAPGQGLEWMGWISPYNGNANYAQKFQGRVTITADESTSTAYMELSSLRSEDTAVYYCARVNSAALVWERLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 132 | DIQMTQSPSSLSASVGDRVTITCRASQSIDRWLNWYQQKPGKAPKLLIYAASSLQSGVPSRFSGSGSGTDFTLTISSLQPEDFATYYCQQSPRYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 133 |
| PSMB130 (FAB PSMB86) | QVQLVQSGAEVKKPGSSVKVSCKASGGTFKSYDISWVRQAPGQGLEWMGGIIPIEGTANYAQKFQGRVTITADESTSTAYMELSSLRSEDTAVYYCARDYPAGYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTL | 134 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 135 |

TABLE 23-continued

Heavy and Light chain sequences of PSMA monoclonal antibodies with corresponding SEQ ID NOs

| mAb ID | Heavy Chain Amino acid sequence | SEQ ID NO | Light Chain Amino Acid Sequence | SEQ ID NO |
|---|---|---|---|---|
| | MISRTPEVTCVVVDVSQEDPEVQFN WYVDGVEVHNAKTKPREEQFNSTYR VVSVLTVLHQDWLNGKEYKCKVSNK GLPSSIEKTISKAKGQPREPQVYTL PPSQEEMTKNQVSLTCLVKGFYPSD IAVEWESNGQPENNYKTTPPVLDSD GSFFLYSRLTVDKSRWQEGNVFSCS VMHEALHNHYTQKSLSLSLGK | | | |
| PSMB128 (FAB PSMB84) | EVQLLESGGGLVQPGGSLRLSCAAS GFTFDSDWMSWVRQAPGKGLEWVSA ISGNGGSTEYADSVKGRFTISRDNS KNTLYLQMNSLRAEDTAVYYCARDP YYYYDGDSYYGMDVWGQGTLVTVSS ASTKGPSVFPLAPCSRSTSESTAAL GCLVKDYFPEPVTVSWNSGALTSGV HTFPAVLQSSGLYSLSSVVTVPSSS LGTKTYTCNVDHKPSNTKVDKRVES KYGPPCPPCPAPEAAGGPSVFLFPP KPKDTLMISRTPEVTCVVVDVSQED PEVQFNWYVDGVEVHNAKTKPREEQ FNSTYRVVSVLTVLHQDWLNGKEYK CKVSNKGLPSSIEKTISKAKGQPRE PQVYTLPPSQEEMTKNQVSLTCLVK GFYPSDIAVEWESNGQPENNYKTTP PVLDSDGSFFLYSRLTVDKSRWQEG NVFSCSVMHEALHNHYTQKSLSLSL GK | 136 | DIQMTQSPSSLSASVGDRVTIT CRASQSISSYLNWYQQKPGKAP KLLIYAASSLQSGVPSRFSGSG SGTDFTLTISSLQPEDFATYYC QQSYSTPLTFGQGTKVEIKRTV AAPSVFIFPPSDEQLKSGTASV VCLLNNFYPREAKVQWKVDNAL QSGNSQESVTEQDSKDSTYSLS STLTLSKADYEKHKVYACEVTH QGLSSPVTKSFNRGEC | 137 |
| PSMB127 (FAB PSMB83) | EVQLLESGGGLVQPGGSLRLSCAAS GFTFKSDAMHWVRQAPGKGLEWVSE ISGSGGYTNYADSVKGRFTISRDNS KNTLYLQMNSLRAEDTAVYYCARDS YDSSLYVGDYFDYWGQGTLVTVSSA STKGPSVFPLAPCSRSTSESTAALG CLVKDYFPEPVTVSWNSGALTSGVH TFPAVLQSSGLYSLSSVVTVPSSSL GTKTYTCNVDHKPSNTKVDKRVESK YGPPCPPCPAPEAAGGPSVFLFPPK PKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREP QVYTLPPSQEEMTKNQVSLTCLVKG FYPSDIAVEWESNGQPENNYKTTPP VLDSDGSFFLYSRLTVDKSRWQEGN VFSCSVMHEALHNHYTQKSLSLSLG K | 138 | EIVLTQSPATLSLSPGERATLS CRASQSVSSYLAWYQQKPGQAP RLLIYDASNRATGIPARFSGSG SGTDFTLTISSLEPEDFAVYYC QQRSNWPLTFGQGTKVEIKRTV AAPSVFIFPPSDEQLKSGTASV VCLLNNFYPREAKVQWKVDNAL QSGNSQESVTEQDSKDSTYSLS STLTLSKADYEKHKVYACEVTH QGLSSPVTKSFNRGEC | 139 |
| PSMB126 (FAB PSMB80) | QVQLVQSGAEVKKPGSSVKVSCKAS GGTFDDYAISWVRQAPGQGLEWMGR IDPIEGTANYAQKFQGRVTITADES TSTAYMELSSLRSEDTAVYYCARDR YYYDGVYWYSDYFDYWGQGTLVTVS SASTKGPSVFPLAPCSRSTSESTAA LGCLVKDYFPEPVTVSWNSGALTSG VHTFPAVLQSSGLYSLSSVVTVPSS SLGTKTYTCNVDHKPSNTKVDKRVE SKYGPPCPPCPAPEAAGGPSVFLFP PKPKDTLMISRTPEVTCVVVDVSQE DPEVQFNWYVDGVEVHNAKTKPREE QFNSTYRVVSVLTVLHQDWLNGKEY KCKVSNKGLPSSIEKTISKAKGQPR EPQVYTLPPSQEEMTKNQVSLTCLV KGFYPSDIAVEWESNGQPENNYKTT PPVLDSDGSFFLYSRLTVDKSRWQE GNVFSCSVMHEALHNHYTQKSLSLS LGK | 140 | DIQMTQSPSSLSASVGDRVTIT CRASQSISSYLNWYQQKPGKAP KLLIYAASSLQSGVPSRFSGSG SGTDFTLTISSLQPEDFATYYC QQSYSTPLTFGQGTKVEIKRTV AAPSVFIFPPSDEQLKSGTASV VCLLNNFYPREAKVQWKVDNAL QSGNSQESVTEQDSKDSTYSLS STLTLSKADYEKHKVYACEVTH QGLSSPVTKSFNRGEC | 137 |
| PSMB124 (FAB PSMB56) | QVQLVQSGAEVKKPGSSVKVSCKAS GGTFSSYAISWVRQAPGQGLEWMGW ISPYNGNANYAQKFQGRVTITADES TSTAYMELSSLRSEDTAVYYCARDS DRSYNLDYWGQGTLVTVSSASTKGP | 141 | DIQMTQSPSSLSASVGDRVTIT CRASQSISGWLNWYQQKPGKAP KLLIYAASSLQSGVPSRFSGSG SGTDFTLTISSLQPEDFATYYC QQSYSTPLTFGQGTKVEIKRTV | 142 |

TABLE 23-continued

Heavy and Light chain sequences of PSMA monoclonal antibodies with corresponding SEQ ID NOs

| mAb ID | Heavy Chain Amino acid sequence | SEQ ID NO | Light Chain Amino Acid Sequence | SEQ ID NO |
|---|---|---|---|---|
| | SVFPLAPCSRSTSESTAALGCLVKD YFPEPVTVSWNSGALTSGVHTFPAV LQSSGLYSLSSVVTVPSSSLGTKTY TCNVDHKPSNTKVDKRVESKYGPPC PPCPAPEAAGGPSVFLFPPKPKDTL MISRTPEVTCVVVDVSQEDPEVQFN WYVDGVEVHNAKTKPREEQFNSTYR VVSVLTVLHQDWLNGKEYKCKVSNK GLPSSIEKTISKAKGQPREPQVYTL PPSQEEMTKNQVSLTCLVKGFYPSD IAVEWESNGQPENNYKTTPPVLDSD GSFFLYSRLTVDKSRWQEGNVFSCS VMHEALHNHYTQKSLSLSLGK | | AAPSVFIFPPSDEQLKSGTASV VCLLNNFYPREAKVQWKVDNAL QSGNSQESVTEQDSKDSTYSLS STLTLSKADYEKHKVYACEVTH QGLSSPVTKSFNRGEC | |
| PSMB123 (FAB PSMB55) | EVQLVQSGAEVKKPGESLKISCKGS GYSFTSYWIGWVRQMPGKGLEWMGI IYPGDSDTRYSPSFQGQVTISADKS ISTAYLQWSSLKASDTAMYYCARGL PIWYLDYWGQGTLVTVSSASTKGPS VFPLAPCSRSTSESTAALGCLVKDY FPEPVTVSWNSGALTSGVHTFPAVL QSSGLYSLSSVVTVPSSSLGTKTYT CNVDHKPSNTKVDKRVESKYGPPCP PCPAPEAAGGPSVFLFPPKPKDTLM ISRTPEVTCVVVDVSQEDPEVQFNW YVDGVEVHNAKTKPREEQFNSTYRV VSVLTVLHQDWLNGKEYKCKVSNKG LPSSIEKTISKAKGQPREPQVYTLP PSQEEMTKNQVSLTCLVKGFYPSDI AVEWESNGQPENNYKTTPPVLDSDG SFFLYSRLTVDKSRWQEGNVFSCSV MHEALHNHYTQKSLSLSLGK | 143 | EIVLTQSPATLSLSPGERATLS CRASQSVASDLAWYQQKPGQAP RLLIYFASNRATGIPARFSGSG SGTDFTLTISSLEPEDFAVYYC QQSITWPFTFGQGTKVEIKRTV AAPSVFIFPPSDEQLKSGTASV VCLLNNFYPREAKVQWKVDNAL QSGNSQESVTEQDSKDSTYSLS STLTLSKADYEKHKVYACEVTH QGLSSPVTKSFNRGEC | 144 |
| PSMB122 (FAB PSMB51) | QVQLVQSGAEVKKPGSSVKVSCKAS GGTFSSYAISWVRQAPGQGLEWMGW IIPYNGNANYAQKFQGRVTITADES TSTAYMELSSLRSEDTAVYYCARVN SAALVWERLDYWGQGTLVTVSSAST KGPSVFPLAPCSRSTSESTAALGCL VKDYFPEPVTVSWNSGALTSGVHTF PAVLQSSGLYSLSSVVTVPSSSLGT KTYTCNVDHKPSNTKVDKRVESKYG PPCPPCPAPEAAGGPSVFLFPPKPK DTLMISRTPEVTCVVVDVSQEDPEV QFNWYVDGVEVHNAKTKPREEQFNS TYRVVSVLTVLHQDWLNGKEYKCKV SNKGLPSSIEKTISKAKGQPREPQV YTLPPSQEEMTKNQVSLTCLVKGFY PSDIAVEWESNGQPENNYKTTPPVL DSDGSFFLYSRLTVDKSRWQEGNVF SCSVMHEALHNHYTQKSLSLSLGK | 145 | DIQMTQSPSSLSASVGDRVTIT CRASQSIDRWLNWYQQKPGKAP KLLIYAASSLQSGVPSRFSGSG SGTDFTLTISSLQPEDFATYYC QQSPRYPLTFGQGTKVEIKRTV AAPSVFIFPPSDEQLKSGTASV VCLLNNFYPREAKVQWKVDNAL QSGNSQESVTEQDSKDSTYSLS STLTLSKADYEKHKVYACEVTH QGLSSPVTKSFNRGEC | 133 |
| PSMB121 (FAB PSMB49) | QVQLVQSGAEVKKPGSSVKVSCKAS GGTFSSYAISWVRQAPGQGLEWMGG IIPIFGTANYAQKFQGRVTITADES TSTAYMELSSLRSEDTAVYYCARAS RVWHASYGYLDYWGQGTLVTVSSAS TKGPSVFPLAPCSRSTSESTAALGC LVKDYFPEPVTVSWNSGALTSGVHT FPAVLQSSGLYSLSSVVTVPSSSLG TKTYTCNVDHKPSNTKVDKRVESKY GPPCPPCPAPEAAGGPSVFLFPPKP KDTLMISRTPEVTCVVVDVSQEDPE VQFNWYVDGVEVHNAKTKPREEQFN STYRVVSVLTVLHQDWLNGKEYKCK VSNKGLPSSIEKTISKAKGQPREPQ VYTLPPSQEEMTKNQVSLTCLVKGF YPSDIAVEWESNGQPENNYKTTPPV LDSDGSFFLYSRLTVDKSRWQEGNV FSCSVMHEALHNHYTQKSLSLSLGK | 146 | EIVLTQSPATLSLSPGERATLS CRASQSVSKWLAWYQQKPGQAP RLLIYDASNRATGIPARFSGSG SGTDFTLTISSLEPEDFAVYYC QQRFTAPWTFGQGTKVEIKRTV AAPSVFIFPPSDEQLKSGTASV VCLLNNFYPREAKVQWKVDNAL QSGNSQESVTEQDSKDSTYSLS STLTLSKADYEKHKVYACEVTH QGLSSPVTKSFNRGEC | 147 |
| PSMB120 (FAB PSMB25) | EVQLVQSGAEVKKPGESLKISCKGS GYSFTSYWIGWVRQMPGKGLEWMGI IYPGDSDTRYSPSFQGQVTISADKS | 148 | DIVMTQSPDSLAVSLGERATIN CKSSQSVLYSSNNKNYLAWYQQ KPGQPPKLLIYWASTRESGVPD | 149 |

TABLE 23-continued

Heavy and Light chain sequences of PSMA monoclonal antibodies with corresponding SEQ ID NOs

| mAb ID | Heavy Chain Amino acid sequence | SEQ ID NO | Light Chain Amino Acid Sequence | SEQ ID NO |
|---|---|---|---|---|
| | ISTAYLQWSSLKASDTAMYYCARGW AYDRGLDYWGQGTLVTVSSASTKGP SVFPLAPCSRSTSESTAALGCLVKD YFPEPVTVSWNSGALTSGVHTFPAV LQSSGLYSLSSVVTVPSSSLGTKTY TCNVDHKPSNTKVDKRVESKYGPPC PPCPAPEAAGGPSVFLFPPKPKDTL MISRTPEVTCVVVDVSQEDPEVQFN WYVDGVEVHNAKTKPREEQFNSTYR VVSVLTVLHQDWLNGKEYKCKVSNK GLPSSIEKTISKAKGQPREPQVYTL PPSQEEMTKNQVSLTCLVKGFYPSD IAVEWESNGQPENNYKTTPPVLDSD GSFFLYSRLTVDKSRWQEGNVFSCS VMHEALHNHYTQKSLSLSLGK | | RFSGSGSGTDFTLTISSLQAED VAVYYCQQYYSTPLTFGQGTKV EIKRTVAAPSVFIFPPSDEQLK SGTASVVCLLNNFYPREAKVQW KVDNALQSGNSQESVTEQDSKD STYSLSSTLTLSKADYEKHKVY ACEVTHQGLSSPVTKSFNRGEC | |
| PSMB119 (FAB PSMB18) | EVQLVQSGAEVKKPGESLKISCKGS GYSFTSYWIGWVRQMPGKGLEWMGI IYPGDSDTRYSPSFQGQVTISADKS ISTAYLQWSSLKASDTAMYYCARAY HYSKGLDYWGQGTLVTVSSASTKGP SVFPLAPCSRSTSESTAALGCLVKD YFPEPVTVSWNSGALTSGVHTFPAV LQSSGLYSLSSVVTVPSSSLGTKTY TCNVDHKPSNTKVDKRVESKYGPPC PPCPAPEAAGGPSVFLFPPKPKDTL MISRTPEVTCVVVDVSQEDPEVQFN WYVDGVEVHNAKTKPREEQFNSTYR VVSVLTVLHQDWLNGKEYKCKVSNK GLPSSIEKTISKAKGQPREPQVYTL PPSQEEMTKNQVSLTCLVKGFYPSD IAVEWESNGQPENNYKTTPPVLDSD GSFFLYSRLTVDKSRWQEGNVFSCS VMHEALHNHYTQKSLSLSLGK | 150 | DIVMTQSPDSLAVSLGERATIN CKSSQSVLYSSNNKNYLAWYQQ KPGQPPKLLIYWASTRESGVPD RFSGSGSGTDFTLTISSLQAED VAVYYCQQYYSTPLTFGQGTKV EIKRTVAAPSVFIFPPSDEQLK SGTASVVCLLNNFYPREAKVQW KVDNALQSGNSQESVTEQDSKD STYSLSSTLTLSKADYEKHKVY ACEVTHQGLSSPVTKSFNRGEC | 149 |
| PSMB87 (FAB PSMB58) | EVQLVQSGAEVKKPGESLKISCKGS GYSFTSYWISWVRQMPGKGLEWMGI IYPGDSYTRYSPSFQGQVTISADKS ISTAYLQWSSLKASDTAMYYCARDY EWELFDSRLDYWGQGTLVTVSSAST KGPSVFPLAPCSRSTSESTAALGCL VKDYFPEPVTVSWNSGALTSGVHTF PAVLQSSGLYSLSSVVTVPSSSLGT KTYTCNVDHKPSNTKVDKRVESKYG PPCPPCPAPEAAGGPSVFLFPPKPK DTLMISRTPEVTCVVVDVSQEDPEV QFNWYVDGVEVHNAKTKPREEQFNS TYRVVSVLTVLHQDWLNGKEYKCKV SNKGLPSSIEKTISKAKGQPREPQV YTLPPSQEEMTKNQVSLTCLVKGFY PSDIAVEWESNGQPENNYKTTPPVL DSDGSFFLYSRLTVDKSRWQEGNVF SCSVMHEALHNHYTQKSLSLSLGK | 151 | DIQMTQSPSSLSASVGDRVTIT CRASQSISSYLNWYQQKPGKAP KLLIYAASSLQSGVPSRFSGSG SGTDFTLTISSLQPEDFATYYC QQSYSTPLTFGQGTKVEIKRTV AAPSVFIFPPSDEQLKSGTASV VCLLNNFYPREAKVQWKVDNAL QSGNSQESVTEQDSKDSTYSLS STLTLSKADYEKHKVYACEVTH QGLSSPVTKSFNRGEC | 137 |

A monospecific anti-PSMA antibody PSMB119 was generated comprising the VH and VL regions having the VH of SEQ ID NO: 130 and the VL of SEQ ID NO: 131 and an IgG4 constant region with S228P, F234A, and L235A substitutions. A monospecific anti-PSMA antibody PSMB120 was generated comprising the VH and VL regions having the VH of SEQ ID NO: 128 and the VL of SEQ ID NO: 129 and an IgG4 constant region with S228P, F234A, and L235A substitutions. A monospecific anti-PSMA antibody PSMB121 was generated comprising the VH and VL regions having the VH of SEQ ID NO: 126 and the VL of SEQ ID NO: 127 and an IgG4 constant region with S228P, F234A, and L235A substitutions. A monospecific anti-PSMA antibody PSMB122 was generated comprising the VH and VL regions having the VH of SEQ ID NO: 125 and the VL of SEQ ID NO: 111 and an IgG4 constant region with S228P, F234A, and L235A substitutions. A monospecific anti-PSMA antibody PSMB123 was generated comprising the VH and VL regions having the VH of SEQ ID NO: 123 and the VL of SEQ ID NO: 124 and an IgG4 constant region with S228P, F234A, and L235A substitutions. A monospecific anti-PSMA antibody PSMB124 was generated comprising the VH and VL regions having the VH of SEQ ID NO: 121 and the VL of SEQ ID NO: 122 and an IgG4 constant region with S228P, F234A, and L235A substitutions. A monospecific anti-PSMA antibody PSMB126 was generated comprising the VH and VL regions having the VH of SEQ ID NO: 118 and the VL of SEQ ID NO: 119 and an IgG4 constant region with S228P, F234A, and L235A substitutions. A monospecific anti-PSMA antibody PSMB127 was generated comprising the VH and VL regions having the VH of SEQ ID NO: 116 and the VL of SEQ ID NO: 117 and an IgG4 constant region with S228P, F234A, and L235A substitutions. A monospecific anti-PSMA antibody PSMB128 was generated comprising the VH and VL regions having the VH of SEQ ID NO: 114 and the VL of SEQ ID NO: 115 and an IgG4 constant region with S228P, F234A, and L235A substitutions. A monospecific anti-PSMA antibody PSMB129 was generated comprising the VH and VL regions having the VH of SEQ ID NO: 110 and the VL of SEQ ID NO: 111 and an IgG4 constant region with S228P, F234A, and L235A substitutions. A monospecific anti-PSMA antibody PSIMB130 was generated comprising the VH and VL regions having the VH of SEQ ID NO: 112 and the VL of SEQ ID NO: 113 and an IgG4 constant region with S228P, F234A, and L235A substitutions.

2-5 Crystal Structure of Human PSMA ECD Bound to Anti-PSMA Fab PSMB83 (aka PSMM84)

PSMA is a homodimeric protein expressed on the cell surface. PSMA is a type II integral glycoprotein of 750 residues per monomer, comprised of a large ECD domain (705 residues) with peptidase activity, a single pass TM domain, and a short 19 residue intracellular domain. The crystal structure of the extracellular region (ECD) of human PSMA bound to the anti-PSMA Fab arm of bispecific antibody PS3B27 was determined to 3.15 Å resolution to better understand the combining site between PSMA and the antibody.

The extracellular region of human PSMA (residues 44-750) was expressed in High Five™ insect cells with an N-terminal gp67 signal peptide followed by a cleavable hexahistidine tag (SEQ ID NO: 596). The secreted protein was purified from supernatant by a three-step procedure comprising of an initial $Ni^{2+}$-NTA affinity capture, TEV-mediated cleavage of the histidine tag followed by an inverse affinity chromatography step, and a final size-exclusion chromatography step. Purified PSMA-ECD was flash-frozen in liquid nitrogen and stored at −80° C. in 10 mM HEPES pH 7.4, 150 mM NaCl, 2 mM $CaCl_2$), 0.1 mM $ZnCl_2$ The Fab of PSMB83 (aka PSMM84), which is the parental anti-PSMA Fab arm in bispecific antibody PS3B27, was expressed in HEK293 Expi cells with a hexahistidine tag (SEQ ID NO: 596) and purified using affinity (HisTrap, GE Healthcare) and size-exclusion chromatography (SEC-300, Phenomenex Yarra). The Fab was stored at 4° C. in 50 mM NaCl, 20 mM Tris pH 7.4 The human PSMA ECD/PSMB83 Fab complex was prepared by a three-step procedure.

First, the Fab was buffer exchanged into 20 mM MES pH 6.0, 150 mM NaCl. Then, the Fab and PSMA were mixed (1.5 molar excess Fab over PSMA monomer) and incubated overnight at 4° C. while dialyzing into 20 mM MES pH 6.0. Finally, the complex was bound to a monoS 5/50 column in 20 mM MES pH 6.0 and eluted with a NaCl gradient.

Crystals suitable for X-ray diffraction were obtained using the sitting drop vapor-diffusion method at 20° C. and a Mosquito LCP robot (TTP Labtech). Crystals of PSMB83 Fab bound to human PSMA ECD were grown from 18% PEG 3 kDa, 0.2 M $(NH_4)_2SO_4$, 0.1 M Tris pH 8.5 with micro-seeds and the PSMA/Fab complex initially at 7.3 mg/mL. Crystals of free PSMB83 Fab were obtained from 25% PEG 3 kDa, 0.2 M LiCl, 0.1 M acetate pH 4.5 with the Fab initially at 8.8 mg/mL.

The structures were solved by molecular replacement (MR) with Phaser (Phaser Crystallographic Software, University of Cambridge). The MR search model for the PSMB83 (aka PSMM84) Fab structure was PDB code 4M60. The PSMA/Fab complex structure was solved using the crystal structures of PSMA (PDB code: 2C6G) and PSMB83 Fab (structure at 1.93 Å resolution; data not shown) as MR search models. The structures were refined with PHENIX (Adams, et al, 2004) and model adjustments were carried out using COOT (Emsley and Cowtan, 2004). All other crystallographic calculations were performed with the CCP4 suite of programs (Collaborative Computational Project Number 4, 1994). All molecular graphics were generated with PyMol (PyMOL Molecular Graphics System, Version 1.4.1, Schrödinger, LLC.) and complementarity determining regions (CDRs) were determined using the Kabat definition.

The PSMA/Fab structure includes Fab light chain residues 1-211, Fab heavy chain residues 1-224 (except for residues 138-146, which are disordered) and PSMA residues 56-750, which corresponds to the protease (residues 56-116 and 352-590), apical (residues 117-351) and helical (residues 591-750) domains, and seven of ten possible N-linked glycans (in Asn-76, -121, -140, -195, -459, -476, and -638) per PSMA dimer subunit. The PSMA active site is located at the interface between the three domains and it contains two zinc atoms coordinated by histidine (H377 and H553) and glutamate/aspartate (D387, catalytic E424, E425, and D453) residues and a water molecule. The crystal asymmetric unit contains one PSMA dimer with each subunit bound in a similar manner to a PSMB83 Fab. The Fab/PSMA combining site is well defined by the electron density map, which allows reliable positioning of the binding residues. The Fab and PSMA molecules are numbered sequentially in FIG. 25-FIG. 30.

The PSMB83 epitope, paratope and interactions. PSMB83, which is the parental anti-PSMA Fab arm in bispecific antibody PS3B27, recognizes a conformational and discontinuous epitope in the apical domain of PSMA (FIG. 25). The PSMA surface area buried by the Fab is around 700 Å$^2$. Specifically, the PSMB83 epitope residues are 1138, F235, P237, G238, D244, Y299, Y300, Q303, K304, E307, and K324-P326. Helix α7 (residues Y299-E307) is a prevalent region of the epitope and binds across the Fab heavy and light chain CDRs. At one end of the helix, Y299 and Y300 form an aromatic cluster with Fab residues Y57$^H$, W94$^L$ and PSMA residues F235 and P237, while E307, at the other helix end, forms a salt bridge with R91$^L$ and hydrogen bonds Y32$^L$. FIG. 26 and FIG. 27 show the main interactions of PSMA with the PSMB83 light and heavy chains. The PSMB83 epitope residues are conserved between human and cynomolgus monkey (FIG. 28) and the bispecific antibody PS3B27 was demonstrated to bind with similar affinity to human and cyno PSMA. In contrast, the human to mouse G238A and, especially, Y300D epitope mutations are expected to lower PSMB83 binding affinity to mouse PSMA in comparison to human. The Y300D mutation disrupts a hydrogen bond contact with N59$^H$ and a π stacking interaction with W94$^L$.

The PSMB83 paratope is composed of residues from all CDRs except CDR-L2 and CDR-H1 (FIG. 29). Specifically, the paratope residues are light chain S30$^L$, Y32$^L$, R91$^L$, S92$^L$, W94$^L$, and heavy chain G56$^H$-N59$^H$, K65$^H$, G66$^H$, Y101$^H$, V107$^H$, and D109$^H$. FIG. 30 shows the interaction contacts between PSMA and PSMB83. The accessible location of the epitope facilitates binding of the PSMB83 Fab arm in the PS3B27 bispecific antibody to membrane-bound PSMA, while the other Fab arm is still bound to CD3 in the T-cell membrane. PSMB83 is not expected to inhibit PSMA enzymatic activity since the antibody binds away from the active site and does not cause any significant structural changes in PSMA that could affect enzymatic function, such as loop movements that close the active site or displacement of catalytic residues (RMSD of 0.3 Å for Cα superposition of PSMA molecules in Fab bound and unbound (Barinka et al, 2007) structures).

2-6 Anti-PSMA Affinity Maturation

Affinity maturation was performed on anti-PSMA Fab phage clones from two PSMA affinity maturation libraries to identify an antibody with increased binding affinity compared to the parental PSMB127 (fab ID=PSMB83, aka PSMM84). Two libraries were generated for affinity maturation of PSMB127). In the first library heavy chain CDR1 and CDR2 were randomized according to the design in Table 24 (PH9H9L1). The H-CDR3 fragment was PCR amplified from pDR000024032 and digested with SacII+XhoI. This fragment was cloned into the PH9H9L1/PH9L3 library. This was transformed into E. coli MC1061F' cells and phage was generated displaying this Fab library. In the second library light chain CDRs were randomized according to the design in Table 25 (PH9L3L3). The heavy chain from PSMB83 (PSMH360) was PCR amplified and digested with NcoI+XhoI. This fragment was cloned into the PH9L3L3 library DNA (ELN: De Novo 2010 phage library SRI-021). This was transformed into E. coli MC1061F' cells and phage was generated displaying this Fab library.

TABLE 24

PH9H9L1 Library design

| Position | Parent AA | Library AA |
|----------|-----------|------------|
| 30 | S | D, K, S |
| 31 | S | D, N, S, T |
| 32 | Y | A, D, S, Y |
| 33 | A | A, D, G, S, W, Y |
| 35 | S | H, N, S |
| 50 | A | A, E, L, N, R, T, W, Y |
| 52 | S | A, D, L, N, R, S |
| 54 | S | A, E, N, S, Y |
| 57 | S | D, N, R, S, T, Y |
| 59 | Y | E, G, N, Q, R, Y |

TABLE 25

PH9L3L3 Library design

| Position | Parent AA | Library AA |
|----------|-----------|------------|
| 30 | S | D, N, R, S |
| 31 | S | N, S, T |
| 32 | Y | D, N, R, S, Y |
| 49 | Y | E, H, K, Y |
| 50 | D | D, G, S, W, Y |
| 53 | N | D, N, S, T, Y |
| 91 | R | A, D, E, G, H, N, R, S, W, Y |
| 92 | S | A, D, E, G, H, N, R, S, W, Y |
| 93 | N | A, D, E, G, H, N, R, S, W, Y |
| 94 | W | A, D, E, G, H, N, R, S, W, Y |
| 96 | L | F, I, L, N, R, W, Y |

A solution panning of the PSMA affinity maturation Fab-pIX libraries was performed against biotinylated human PSMA ECD for three rounds. The phage-bound antigen was captured on neutravidin beads (GE HealthCare Life Science Cat #78152104011150) according to the manufacturer's protocol, followed by extensive washes in 1×PBST (0.05% tween 20) and an hour-long incubation with unlabeled PSMA ECD in 500-fold molar excess of the biotinylated antigen. This panning yielded the clones, PSMXP46R3_59H09, PSMXP46R3_59H06, PSMXP46R3_59E03, PSMXP46R3_59C09, PSMXP46R3_59H01, PSMXP46R3_59F11, and PSMXP46R3_59F07.

To determine the expression level of the anti-PSMA fab clones, 96 well Maxisorb plates were coated overnight at 4 C with anti-human Fd IgG, washed, and blocked with 3% milk-PBS-0.05% Tween for 1 hour. The phage supernatant samples were serially diluted 2-fold for 11 dilutions in blocking buffer with the final well blank. 100 ul of these solutions were captured on the coated plates for 1 hour. The plates were washed and 100 ul of anti-F(ab')2-HRP antibody was added for 1 hour. Plates were washed and developed with 100 ul of peroxidase reagent and luminescence was read on the Envision (FIG. 31).

To determine the binding of the anti-PSMA fab clones to human and cynomolgus recombinant protein, 96 well Maxisorb plates were coated with 100 ul of 5 ug/ml neutravidin overnight at 4 C. The plates were washed and blocked with 3% milk-PBS-0.05% Tween for 1 hour. Recombinant biotinylated human and cynomolgus PSMA proteins were captured at 2.5 ug/ml for 1 hour at room temperature. The plates were washed and 100 ul of 2-fold serially diluted fab supernatant was capture for 1 hour at RT. The plate was washed and then there was a 2.5-hour incubation with 200 ul 0.3% milk in PBST to wash away some of the weak affinity fabs. Then there was another 30 minutes incubation with fresh 200 ul 0.3% milk in PBST to remove more weak affinity fabs. The plates were washed and 100 ul of anti-F(ab')2-HRP antibody was added for 1 hour. Plates were washed and developed with 100 ul of peroxidase reagent and luminescence was read on the Envision (FIG. 32 and FIG. 33).

FIG. 31 demonstrates that the protein expression of the parental Fab and affinity matured Fabs were similar. The y axis values represent the luminescence of the detection reagent which equates to the abundance of fab protein over the dilution curve; the higher the luminescence reading, the more protein in the well which decreased with successive two-fold dilutions. There was more protein in the wells with affinity mature fabs but the increase over the parental is at most five times greater as demonstrated by the EC50 values (which is the concentration of protein that gives half of the maximal response). These data demonstrate the difference in PSMA binding profiles in FIG. 32 and FIG. 33 is not due to a difference in Fab concentration.

FIG. 32 demonstrates improved binding of the affinity matured Fabs to the human recombinant antigen over the parental anti-PSMA Fab (PSMB83). Again, the y axis of the graph represents luminescence values. In this case the larger the value means more Fab bound to the human PSMA protein. This is a measure of binding as increased concentrations of Fab (along the x axis) generate higher luminescence values. There was negligible binding of the parental Fab under these conditions as demonstrated by the absence of signal even at high concentrations (open circles along the x axis). Binding of the affinity matured fabs was observed over the concentrations tested which equates to stronger binding capacity to the human PSMA protein. Given that parental Fab binding to human PSMA protein was zero, no EC50 could be generated.

FIG. 33 demonstrates improved binding of the affinity matured Fabs to the cynomolgus recombinant antigen over the parental anti-PSMA Fab (PSMB83). Again, the y axis of the graph represents luminescence values. In this case the larger the value means more Fab bound to the cynomolgus PSMA protein. This is a measure of binding as increased concentrations of Fab (along the x axis) generate higher luminescence values. There was negligible binding of the parental Fab under these conditions as demonstrated by the absence of signal even at high concentrations (open circles along the x axis). Binding of the affinity matured Fabs was observed over the concentrations tested which equates to stronger binding capacity to the human PSMA protein. Given that parental Fab binding to human PSMA protein was zero, no EC50 could be generated for direct comparison.

Overall, the phages' Fab binding profiles demonstrate improved binding to the human and cynomolgus recombinant antigen over the parental anti-PSMA mAb (PSMB127). This improvement is not a result of differences in Fab expression profiles, as demonstrated by FIG. 33 and FIG. 34, showing binding of affinity mature Fabs normalized to Fab expression levels. The top five Fab candidates identified from the ELISA screen were produced in monoclonal antibody format on IgG4 PAA. Table 26 lists the subsequent Mab identifiers and Tables 27 and 28 depict sequences for their variable regions and the sequences for the heavy and light chains, respectively.

TABLE 26

Top five affinity mature antibodies identified based on the ELISA

| Well ID | HC SEQ ID | LC SEQ ID | MAB protein IDs |
|---|---|---|---|
| PSMXP46R3_59C09 | PSMH859 | PSML160 | PSMB346 |
| PSMXP46R3_59E03 | PSMH859 | PSML159 | PSMB345 |
| PSMXP46R3_59F07 | PSMH862 | PSML158 | PSMB349 |
| PSMXP46R3_59H01 | PSMH860 | PH9L3 | PSMB347 |
| PSMXP46R3_59H06 | PSMH859 | PH9L3 | PSMB344 |

TABLE 27

VH and VL sequences of top five PSMA Fab candidates

| MAB ID | VH Amino acid sequence | SEQ ID NO | VL Amino Acid Sequence | SEQ ID NO |
|---|---|---|---|---|
| PSMB344 | EVQLLESGGGLVQPGGSLRLSCAASG FTFKSDAMHWVRQAPGKGLEWVSEIS GSGGYTNYADSMKGRFTISRDNSKNT LYLQMNSLRAEDTAVYYCARDSYDSS LYVGDYFDYWGQGTLVTVSS | 6 | EIVLTQSPATLSLSPGERATLS CRASQSVSSYLAWYQQKPGQAP RLLIYDASNRATGIPARFSGSG SGTDFTLTISSLEPEDFAVYYC QQRSNWPLTFGQGTKVEIK | 117 |
| PSMB345 | EVQLLESGGGLVQPGGSLRLSCAASG FTFKSDAMHWVRQAPGKGLEWVSEIS GSGGYTNYADSMKGRFTISRDNSKNT LYLQMNSLRAEDTAVYYCARDSYDSS LYVGDYFDYWGQGTLVTVSS | 6 | EIVLTQSPATLSLSPGERATLS CRASQSVSNYLAWYQQKPGQAP RLLIHDASNRATGIPARFSGSG SGTDFTLTISSLEPEDFAVYYC QQRRNWPLTFGQGTKVEIK | 9 |
| PSMB346 | EVQLLESGGGLVQPGGSLRLSCAASG FTFKSDAMHWVRQAPGKGLEWVSEIS GSGGYTNYADSMKGRFTISRDNSKNT LYLQMNSLRAEDTAVYYCARDSYDSS LYVGDYFDYWGQGTLVTVSS | 6 | EIVLTQSPATLSLSPGERATLS CRASQSVSSYLAWYQQKPGQAP RLLIYDASYRATGIPARFSGSG SGTDFTLTISSLEPEDFAVYYC QQRRNWPLTFGQGTKVEIK | 682 |
| PSMB347 | EVQLLESGGGLVQPGGSLRLSCAASG FTFKSDAMHWVRQAPGKGLEWVSEIS GSGGYTNYADSMKSRFTISRDNSKNT LYLQMNSLRAEDTAVYYCARDSYDSS LYVGDYFDYWGQGTLVTVSS | 7 | EIVLTQSPATLSLSPGERATLS CRASQSVSSYLAWYQQKPGQAP RLLIYDASNRATGIPARFSGSG SGTDFTLTISSLEPEDFAVYYC QQRSNWPLTFGQGTKVEIK | 117 |
| PSMB349 | EVQLLESGGGLVQPGGSLRLSCAASG FTFKSDAMHWVRQAPGKGLEWVSEIS GSGGYTNYADSLKGRFTISRDNSKNT LYLQMNSLRAEDTAVYYCARDSYDSS LYVGDYFDYWGQGTLVTVSS | 8 | EIVLTQSPATLSLSPGERATLS CRASQSVSSYLAWYQQKPGQAP RLLIYDASNRATGIPARFSGSG SGTDFTLTISSLEPEDFAVYYC QQRGNWPLTFGQGTKVEIK | 10 |

TABLE 28

Heavy Chain and Light Chain sequences of top five PSMA candidates in monoclonal antibody format on IgG4 PAA

| mAb ID | Heavy Chain Amino acid sequence | SEQ ID NO | Light Chain Amino Acid Sequence | SEQ ID NO |
|---|---|---|---|---|
| PSMB344 | EVQLLESGGGLVQPGGSLRLSCAA SGFTFKSDAMHWVRQAPGKGLEWV SEISGSGGYTNYADSMKGRFTISR DNSKNTLYLQMNSLRAEDTAVYYC ARDSYDSSLYVGDYFDYWGQGTLV TVSSASTKGPSVFPLAPCSRSTSE STAALGCLVKDYFPEPVTVSWNSG ALTSGVHTFPAVLQSSGLYSLSSV VTVPSSSLGTKTYTCNVDHKPSNT KVDKRVESKYGPPCPPCPAPEAAG GPSVFLFPPKPKDTLMISRTPEVT CVVVDVSQEDPEVQFNWYVDGVEV HNAKTKPREEQFNSTYRVVSVLTV LHQDWLNGKEYKCKVSNKGLPSSI EKTISKAKGQPREPQVYTLPPSQE EMTKNQVSLTCLVKGFYPSDIAVE WESNGQPENNYKTTPPVLDSDGSF FLYSRLTVDKSRWQEGNVFSCSVM HEALHNHYTQKSLSLSLGK | 11 | EIVLTQSPATL SLSPGERATLS CRASQSVSSYL AWYQQKPGQAP RLLIYDASNRA TGIPARFSGSG SGTDFTLTISS LEPEDFAVYYC QQRSNWPLTFG QGTKVEIKRTV AAPSVFIFPPS DEQLKSGTASV VCLLNNFYPRE AKVQWKVDNAL QSGNSQESVTE QDSKDSTYSLS STLTLSKADYE KHKVYACEVTH QGLSSPVTKSF NRGEC | 139 |
| PSMB345 | EVQLLESGGGLVQPGGSLRLSCAA SGFTFKSDAMHWVRQAPGKGLEWV SEISGSGGYTNYADSMKGRFTISR DNSKNTLYLQMNSLRAEDTAVYYC ARDSYDSSLYVGDYFDYWGQGTLV TVSSASTKGPSVFPLAPCSRSTSE STAALGCLVKDYFPEPVTVSWNSG ALTSGVHTFPAVLQSSGLYSLSSV VTVPSSSLGTKTYTCNVDHKPSNT | 11 | EIVLTQSPATL SLSPGERATLS CRASQSVSNYL AWYQQKPGQAP RLLIHDASNRA TGIPARFSGSG SGTDFTLTISS LEPEDFAVYYC QQRRNWPLTFG | 14 |

TABLE 28-continued

Heavy Chain and Light Chain sequences of top five PSMA candidates in monoclonal antibody format on IgG4 PAA

| mAb ID | Heavy Chain Amino acid sequence | SEQ ID NO | Light Chain Amino Acid Sequence | SEQ ID NO |
|---|---|---|---|---|
| | KVDKRVESKYGPPCPPCPAPEAAG GPSVFLEPPKPKDTLMISRTPEVT CVVVDVSQEDPEVQFNWYVDGVEV HNAKTKPREEQFNSTYRVVSVLTV LHQDWLNGKEYKCKVSNKGLPSSI EKTISKAKGQPREPQVYTLPPSQE EMTKNQVSLTCLVKGFYPSDIAVE WESNGQPENNYKTTPPVLDSDGSF FLYSRLTVDKSRWQEGNVFSCSVM HEALHNHYTQKSLSLSLGK | | QGTKVEIKRTV AAPSVFIFPPS DEQLKSGTASV VCLLNNFYPRE AKVQWKVDNAL QSGNSQESVTE QDSKDSTYSLS STLTLSKADYE KHKVYACEVTH QGLSSPVTKSF NRGEC | |
| PSMB346 | EVQLLESGGGLVQPGGSLRLSC AASGFTFKSDAMHWVRQAPGKG LEWVSEISGSGGYTNYADSMKG RFTISRDNSKNTLYLQMNSLRA EDTAVYYCARDSYDSSLYVGDY FDYWGQGTLVTVSSASTKGPSV FPLAPCSRSTSESTAALGCLVK DYFPEPVTVSWNSGALTSGVHT FPAVLQSSGLYSLSSVVTVPSS SLGTKTYTCNVDHKPSNTKVDK RVESKYGPPCPPCPAPEAAGGP SVFLFPPKPKDTLMISRIPEVT CVVVDVSQEDPEVQFNWYVDGV EVHNAKTKPREEQFNSTYRVVS VLTVLHQDWLNGKEYKCKVSNK GLPSSIEKTISKAKGQPREPQV YTLPPSQEEMTKNQVSLTCLVK GFYPSDIAVEWESNGQPENNYK TTPPVLDSDGSFFLYSRLTVDK SRWQEGNVFSCSVMHEALHNHY TQKSLSLSLGK | 11 | EIVLTQSPATL SLSPGERATLS CRASQSVSSYL AWYQQKPGQAP RLLIYDASYRA TGIPARFSGSG SGTDFTLTISS LEPEDFAVYYC QQRRNWPLTFG QGTKVEIKRTV AAPSVFIFPPS DEQLKSGTASV VCLLNNFYPRE AKVQWKVDNAL QSGNSQESVTE QDSKDSTYSLS STLTLSKADYE KHKVYACEVTH QGLSSPVTKSF NRGEC | 680 |
| PSMB347 | EVQLLESGGGLVQPGGSLRLSC AASGFTFKSDAMHWVRQAPGKG LEWVSEISGSGGYTNYADSMKS RFTISRDNSKNTLYLQMNSLRA EDTAVYYCARDSYDSSLYVGDY FDYWGQGTLVTVSSASTKGPSV FPLAPCSRSTSESTAALGCLVK DYFPEPVTVSWNSGALTSGVHT FPAVLQSSGLYSLSSVVTVPSS SLGTKTYTCNVDHKPSNTKVDK RVESKYGPPCPPCPAPEAAGGP SVFLFPPKPKDTLMISRIPEVT CVVVDVSQEDPEVQFNWYVDGV EVHNAKTKPREEQFNSTYRVVS VLTVLHQDWLNGKEYKCKVSNK GLPSSIEKTISKAKGQPREPQV YTLPPSQEEMTKNQVSLTCLVK GFYPSDIAVEWESNGQPENNYK TTPPVLDSDGSFFLYSRLTVDK SRWQEGNVFSCSVMHEALHNHY TQKSLSLSLGK | 12 | EIVLTQSPATL SLSPGERATLS CRASQSVSSYL AWYQQKPGQAP RLLIYDASNRA TGIPARFSGSG SGTDFTLTISS LEPEDFAVYYC QQRSNWPLTFG QGTKVEIKRTV AAPSVFIFPPS DEQLKSGTASV VCLLNNFYPRE AKVQWKVDNAL QSGNSQESVTE QDSKDSTYSLS STLTLSKADYE KHKVYACEVTH QGLSSPVTKSF NRGEC | 139 |
| PSMB349 | EVQLLESGGGLVQPGGSLRLSC AASGFTFKSDAMHWVRQAPGKG LEWVSEISGSGGYTNYADSLKG RFTISRDNSKNTLYLQMNSLRA EDTAVYYCARDSYDSSLYVGDY FDYWGQGTLVTVSSASTKGPSV FPLAPCSRSTSESTAALGCLVK DYFPEPVTVSWNSGALTSGVHT FPAVLQSSGLYSLSSVVTVPSS SLGTKTYTCNVDHKPSNTKVDK RVESKYGPPCPPCPAPEAAGGP SVFLFPPKPKDTLMISRIPEVT CVVVDVSQEDPEVQFNWYVDGV EVHNAKTKPREEQFNSTYRVVS VLTVLHQDWLNGKEYKCKVSNK GLPSSIEKTISKAKGQPREPQV YTLPPSQEEMTKNQVSLTCLVK GFYPSDIAVEWESNGQPENNYK TTPPVLDSDGSFFLYSRLTVDK SRWQEGNVFSCSVMHEALHNHY TQKSLSLSLGK | 13 | EIVLTQSPATL SLSPGERATLS CRASQSVSSYL AWYQQKPGQAP RLLIYDASNRA TGIPARFSGSG SGTDFTLTISS LEPEDFAVYYC QQRGNWPLTFG QGTKVEIKRTV AAPSVFIFPPS DEQLKSGTASV VCLLNNFYPRE AKVQWKVDNAL QSGNSQESVTE QDSKDSTYSLS STLTLSKADYE KHKVYACEVTH QGLSSPVTKSF NRGEC | 15 |

The 3 different HC and 4 different LC were combined in a matrix format to expand the diversity of hits (Table 29). Given that the methionine in the CDR2 of PSMH860 is a posttranslational risk, a new sequence was generated with M64L and identified as PSMH865. PSMH865 was paired with PSML160 to generate Mab PSMB365.

TABLE 29

Matrix format of the 3 heavy chains and 4 light chains combined

| | PSMH859 | PSMH860 | PSMH862 |
|---|---|---|---|
| PH9L3 | PSMB344 | PSMB347 | PSMB358 |
| PSML158 | — | PSMB361 | PSMB349 |
| PSML159 | PSMB345 | PSMB362 | PSMB359 |
| PSML160 | PSMB346 | PSMB363 | PSMB360 |

Tables 30 and 31 depict the sequences for the matrix recombined variable regions and the sequences for the heavy and light chains, respectively.

TABLE 30

VH and VL sequences of matrix recombined PSMA hits

| MAB ID | VH Amino acid sequence | SEQ ID NO | VL Amino Acid Sequence | SEQ ID NO |
|---|---|---|---|---|
| PSMB358 | EVQLLESGGGLVQPGG SLRLSCAASGFTFKSD AMHWVRQAPGKGLEWV SEISGSGGYTNYADSL KGRFTISRDNSKNTLY LQMNSLRAEDTAVYYC ARDSYDSSLYVGDYFD YWGQGTLVTVSS | 8 | EIVLTQSPATLSLSPGE RATLSCRASQSVSSYLA WYQQKPGQAPRLLIYDA SNRATGIPARFSGSGSG TDFTLTISSLEPEDFAV YYCQQRSNWPLTFGQGT KVEIK | 117 |
| PSMB359 | EVQLLESGGGLVQPGG SLRLSCAASGFTFKSD AMHWVRQAPGKGLEWV SEISGSGGYTNYADSL KGRFTISRDNSKNTLY LQMNSLRAEDTAVYYC ARDSYDSSLYVGDYFD YWGQGTLVTVSS | 8 | EIVLTQSPATLSLSPGE RATLSCRASQSVSNYLA WYQQKPGQAPRLLIHDA SNRATGIPARFSGSGSG TDFTLTISSLEPEDFAV YYCQQRRNWPLTFGQGT KVEIK | 9 |
| PSMB360 | EVQLLESGGGLVQPGG SLRLSCAASGFTFKSD AMHWVRQAPGKGLEWV SEISGSGGYTNYADSL KGRFTISRDNSKNTLY LQMNSLRAEDTAVYYC ARDSYDSSLYVGDYFD YWGQGTLVTVSS | 8 | EIVLTQSPATLSLSPGE RATLSCRASQSVSSYLA WYQQKPGQAPRLLIYDA SYRATGIPARFSGSGSG TDFTLTISSLEPEDFAV YYCQQRRNWPLTFGQGT KVEIK | 682 |
| PSMB361 | EVQLLESGGGLVQPGG SLRLSCAASGFTFKSD AMHWVRQAPGKGLEWV | 7 | EIVLTQSPATLSLSPGE RATLSCRASQSVSSYLA WYQQKPGQAPRLLIYDA | 10 |

TABLE 30-continued

VH and VL sequences of matrix recombined PSMA hits

| MAB ID | VH Amino acid sequence | SEQ ID NO | VL Amino Acid Sequence | SEQ ID NO |
|---|---|---|---|---|
| | SEISGSGGYTNYADSM KSRFTISRDNSKNTLY LQMNSLRAEDTAVYYC ARDSYDSSLYVGDYFD YWGQGTLVTVSS | | SNRATGIPARFSGSGS TDFTLTISSLEPEDFAV YYCQQRGNWPLTFGQGT KVEIK | |
| PSMB362 | EVQLLESGGGLVQPGG SLRLSCAASGFTFKSD AMHWVRQAPGKGLEWV SEISGSGGYTNYADSM KSRFTISRDNSKNTLY LQMNSLRAEDTAVYYC ARDSYDSSLYVGDYFD YWGQGTLVTVSS | 7 | EIVLTQSPATLSLSPGE RATLSCRASQSVSNYLA WYQQKPGQAPRLLIHDA SNRATGIPARFSGSGS TDFTLTISSLEPEDFAV YYCQQRRNWPLTFGQGT KVEIK | 9 |
| PSMB363 | EVQLLESGGGLVQPGG SLRLSCAASGFTFKSD AMHWVRQAPGKGLEWV SEISGSGGYTNYADSM KSRFTISRDNSKNTLY LQMNSLRAEDTAVYYC ARDSYDSSLYVGDYFD YWGQGTLVTVSS | 7 | EIVLTQSPATLSLSPGE RATLSCRASQSVSSYLA WYQQKPGQAPRLLIYDA SYRATGIPARFSGSGS TDFTLTISSLEPEDFAV YYCQQRRNWPLTFGQGT KVEIK | 682 |
| PSMB365 | EVQLLESGGGLVQPGG SLRLSCAASGFTFKSD AMHWVRQAPGKGLEWV SEISGSGGYTNYADSL KSRFTISRDNSKNTLY LQMNSLRAEDTAVYYC ARDSYDSSLYVGDYFD YWGQGTLVTVSS | 681 | EIVLTQSPATLSLSPGE RATLSCRASQSVSSYLA WYQQKPGQAPRLLIYDA SYRATGIPARFSGSGS TDFTLTISSLEPEDFAV YYCQQRRNWPLTFGQGT KVEIK | 682 |

TABLE 31

Heavy Chain and Light Chain sequences of matrix recombined PSMA hits

| MAB ID | Heavy Chain Amino acid sequence | SEQ ID NO | Light Chain AminoAcid Sequence | SEQ ID NO |
|---|---|---|---|---|
| PSMB358 | EVQLLESGGGLVQPGG SLRLSCAASGFTFKSD AMHWVRQAPGKGLEWV SEISGSGGYTNYADSL KGRFTISRDNSKNTLY LQMNSLRAEDTAVYYC ARDSYDSSLYVGDYFD YWGQGTLVTVSSASTK GPSVFPLAPCSRSTSE STAALGCLVKDYFPEP VTVSWNSGALTSGVHT FPAVLQSSGLYSLSSV VTVPSSSLGTKTYTCN VDHKPSNTKVDKRVES KYGPPCPPCPAPEAAG GPSVFLFPPKPKDTLM ISRTPEVTCVVVDVSQ EDPEVQFNWYVDGVEV HNAKTKPREEQFNSTY RVVSVLTVLHQDWLNG KEYKCKVSNKGLPSSI EKTISKAKGQPREPQV YTLPPSQEEMTKNQVS LTCLVKGFYPSDIAVE WESNGQPENNYKTTPP VLDSDGSFFLYSRLTV DKSRWQEGNVFSCSVM HEALHNHYTQKSLSLS LGK | 13 | EIVLTQSPATLSLSPGE RATLSCRASQSVSSYLA WYQQKPGQAPRLLIYDA SNRATGIPARFSGSGS TDFTLTISSLEPEDFAV YYCQQRSNWPLTFGQGT KVEIKRTVAAPSVFIFP PSDEQLKSGTASVVCLL NNFYPREAKVQWKVDNA LQSGNSQESVTEQDSKD STYSLSSTLTLSKADYE KHKVYACEVTHQGLSSP VTKSFNRGEC | 139 |
| PSMB359 | EVQLLESGGGLVQPGG SLRLSCAASGFTFKSD AMHWVRQAPGKGLEWV SEISGSGGYTNYADSL KGRFTISRDNSKNTLY LQMNSLRAEDTAVYYC ARDSYDSSLYVGDYFD YWGQGTLVTVSSASTK GPSVFPLAPCSRSTSE STAALGCLVKDYFPEP VTVSWNSGALTSGVHT FPAVLQSSGLYSLSSV VTVPSSSLGTKTYTCN VDHKPSNTKVDKRVES KYGPPCPPCPAPEAAG GPSVFLFPPKPKDTLM ISRTPEVTCVVVDVSQ EDPEVQFNWYVDGVEV HNAKTKPREEQFNSTY RVVSVLTVLHQDWLNG KEYKCKVSNKGLPSSI EKTISKAKGQPREPQV YTLPPSQEEMTKNQVS LTCLVKGFYPSDIAVE WESNGQPENNYKTTPP VLDSDGSFFLYSRLTV DKSRWQEGNVFSCSVM HEALHNHYTQKSLSLS LGK | 13 | EIVLTQSPATLSLSPGE RATLSCRASQSVSNYLA WYQQKPGQAPRLLIHDA SNRATGIPARFSGSGS TDFTLTISSLEPEDFAV YYCQQRRNWPLTFGQGT KVEIKRTVAAPSVFIFP PSDEQLKSGTASVVCLL NNFYPREAKVQWKVDNA LQSGNSQESVTEQDSKD STYSLSSTLTLSKADYE KHKVYACEVTHQGLSSP VTKSFNRGEC | 14 |
| PSMB360 | EVQLLESGGGLVQPGG SLRLSCAASGFTFKSD AMHWVRQAPGKGLEWV SEISGSGGYTNYADSL KGRFTISRDNSKNTLY LQMNSLRAEDTAVYYC ARDSYDSSLYVGDYFD YWGQGTLVTVSSASTK GPSVFPLAPCSRSTSE STAALGCLVKDYFPEP VTVSWNSGALTSGVHT FPAVLQSSGLYSLSSV VTVPSSSLGTKTYTCN VDHKPSNTKVDKRVES KYGPPCPPCPAPEAAG GPSVFLFPPKPKDTLM ISRTPEVTCVVVDVSQ EDPEVQFNWYVDGVEV HNAKTKPREEQFNSTY RVVSVLTVLHQDWLNG KEYKCKVSNKGLPSSI EKTISKAKGQPREPQV YTLPPSQEEMTKNQVS LTCLVKGFYPSDIAVE WESNGQPENNYKTTPP VLDSDGSFFLYSRLTV DKSRWQEGNVFSCSVM HEALHNHYTQKSLSLS LGK | 13 | EIVLTQSPATLSLSPGE RATLSCRASQSVSSYLA WYQQKPGQAPRLLIYDA SYRATGIPARFSGSGS TDFTLTISSLEPEDFAV YYCQQRRNWPLTFGQGT KVEIKRTVAAPSVFIFP PSDEQLKSGTASVVCLL NNFYPREAKVQWKVDNA LQSGNSQESVTEQDSKD STYSLSSTLTLSKADYE KHKVYACEVTHQGLSSP VTKSFNRGEC | 680 |
| PSMB361 | EVQLLESGGGLVQPGG SLRLSCAASGFTFKSD AMHWVRQAPGKGLEWV SEISGSGGYTNYADSM KSRFTISRDNSKNTLY LQMNSLRAEDTAVYYC ARDSYDSSLYVGDYFD YWGQGTLVTVSSASTK GPSVFPLAPCSRSTSE | 12 | EIVLTQSPATLSLSPGE RATLSCRASQSVSSYLA WYQQKPGQAPRLLIYDA SNRATGIPARFSGSGS TDFTLTISSLEPEDFAV YYCQQRGNWPLTFGQGT KVEIKRTVAAPSVFIFP PSDEQLKSGTASVVCLL NNFYPREAKVQWKVDNA | 15 |

TABLE 31-continued

Heavy Chain and Light Chain sequences of matrix recombined PSMA hits

| MAB ID | Heavy Chain Amino acid sequence | SEQ ID NO | Light Chain AminoAcid Sequence | SEQ ID NO |
|---|---|---|---|---|
| | STAALGCLVKDYFPEP VTVSWNSGALTSGVHT FPAVLQSSGLYSLSSV VTVPSSSLGTKTYTCN VDHKPSNTKVDKRVES KYGPPCPPCPAPEAAG GPSVFLFPPKPKDTLM ISRTPEVTCVVVDVSQ EDPEVQFNWYVDGVEV HNAKTKPREEQFNSTY RVVSVLTVLHQDWLNG KEYKCKVSNKGLPSSI EKTISKAKGQPREPQV YTLPPSQEEMTKNQVS LTCLVKGFYPSDIAVE WESNGQPENNYKTTPP VLDSDGSFFLYSRLTV DKSRWQEGNVFSCSVM HEALHNHYTQKSLSLS LGK | | LQSGNSQESVTEQDSKD STYSLSSTLTLSKADYE KHKVYACEVTHQGLSSP VTKSFNRGEC | |
| PSMB362 | EVQLLESGGGLVQPGG SLRLSCAASGFTFKSD AMHWVRQAPGKGLEWV SEISGSGGYTNYADSM KSRFTISRDNSKNTLY LQMNSLRAEDTAVYYC ARDSYDSSLYVGDYFD YWGQGTLVTVSSASTK GPSVFPLAPCSRSTSE STAALGCLVKDYFPEP VTVSWNSGALTSGVHT FPAVLQSSGLYSLSSV VTVPSSSLGTKTYTCN VDHKPSNTKVDKRVES KYGPPCPPCPAPEAAG GPSVFLFPPKPKDTLM ISRTPEVTCVVVDVSQ EDPEVQFNWYVDGVEV HNAKTKPREEQFNSTY RVVSVLTVLHQDWLNG KEYKCKVSNKGLPSSI EKTISKAKGQPREPQV YTLPPSQEEMTKNQVS LTCLVKGFYPSDIAVE WESNGQPENNYKTTPP VLDSDGSFFLYSRLTV DKSRWQEGNVFSCSVM HEALHNHYTQKSLSLS LGK | 12 | EIVLTQSPATLSLSPGE RATLSCRASQSVSNYLA WYQQKPGQAPRLLIHDA SNRATGIPARFSGSGSG TDFTLTISSLEPEDFAV YYCQQRRNWPLTFGQGT KVEIKRTVAAPSVFIFP PSDEQLKSGTASVVCLL NNFYPREAKVQWKVDNA LQSGNSQESVTEQDSKD STYSLSSTLTLSKADYE KHKVYACEVTHQGLSSP VTKSFNRGEC | 14 |
| PSMB363 | EVQLLESGGGLVQPGG SLRLSCAASGFTFKSD AMHWVRQAPGKGLEWV SEISGSGGYTNYADSM KSRFTISRDNSKNTLY LQMNSLRAEDTAVYYC ARDSYDSSLYVGDYFD YWGQGTLVTVSSASTK GPSVFPLAPCSRSTSE STAALGCLVKDYFPEP VTVSWNSGALTSGVHT FPAVLQSSGLYSLSSV VTVPSSSLGTKTYTCN VDHKPSNTKVDKRVES KYGPPCPPCPAPEAAG GPSVFLFPPKPKDTLM ISRTPEVTCVVVDVSQ EDPEVQFNWYVDGVEV HNAKTKPREEQFNSTY RVVSVLTVLHQDWLNG KEYKCKVSNKGLPSSI EKTISKAKGQPREPQV | 12 | EIVLTQSPATLSLSPGE RATLSCRASQSVSSYLA WYQQKPGQAPRLLIYDA SYRATGIPARFSGSGSG TDFTLTISSLEPEDFAV YYCQQRRNWPLTFGQGT KVEIKRTVAAPSVFIFP PSDEQLKSGTASVVCLL NNFYPREAKVQWKVDNA LQSGNSQESVTEQDSKD STYSLSSTLTLSKADYE KHKVYACEVTHQGLSSP VTKSFNRGEC | 680 |
| | YTLPPSQEEMTKNQVS LTCLVKGFYPSDIAVE WESNGQPENNYKTTPP VLDSDGSFFLYSRLTV DKSRWQEGNVFSCSVM HEALHNHYTQKSLSLS LGK | | | |
| PSMB365 | EVQLLESGGGLVQPGG SLRLSCAASGFTFKSD AMHWVRQAPGKGLEWV SEISGSGGYTNYADSL KSRFTISRDNSKNTLY LQMNSLRAEDTAVYYC ARDSYDSSLYVGDYFD YWGQGTLVTVSSASTK GPSVFPLAPCSRSTSE STAALGCLVKDYFPEP VTVSWNSGALTSGVHT FPAVLQSSGLYSLSSV VTVPSSSLGTKTYTCN VDHKPSNTKVDKRVES KYGPPCPPCPAPEAAG GPSVFLFPPKPKDTLM ISRTPEVTCVVVDVSQ EDPEVQFNWYVDGVEV HNAKTKPREEQFNSTY RVVSVLTVLHQDWLNG KEYKCKVSNKGLPSSI EKTISKAKGQPREPQV YTLPPSQEEMTKNQVS LTCLVKGFYPSDIAVE WESNGQPENNYKTTPP VLDSDGSFFLYSRLTV DKSRWQEGNVFSCSVM HEALHNHYTQKSLSLS LGK | 679 | EIVLTQSPATLSLSPGE RATLSCRASQSVSSYLA WYQQKPGQAPRLLIYDA SYRATGIPARFSGSGSG TDFTLTISSLEPEDFAV YYCQQRRNWPLTFGQGT KVEIKRTVAAPSVFIFP PSDEQLKSGTASVVCLL NNFYPREAKVQWKVDNA LQSGNSQESVTEQDSKD STYSLSSTLTLSKADYE KHKVYACEVTHQGLSSP VTKSFNRGEC | 631 |

Table 32 shows the CDR sequences for all affinity-matured PSMA hits.

TABLE 32

CDR sequences of affinity-matured PSMA hits

| MAB ID | | CDR1 | CDR2 | CDR3 |
|---|---|---|---|---|
| PSMB344 | HC | SDAMH (78) | EISGSGGYT NYADSMKG (1) | DSYDSSLYV GDYFDY (80) |
| | LC | RASQSVSSYLA (81) | DASNRAT (82) | QQRSNWPLT (83) |
| PSMB345 | HC | SDAMH (78) | EISGSGGYT NYADSMKG (1) | DSYDSSLYV GDYFDY (80) |
| | LC | RASQSVSNYLA (4) | DASNRAT (82) | QQRRNWPLT (686) |
| PSMB346 | HC | SDAMH (78) | EISGSGGYT NYADSMKG (1) | DSYDSSLYV GDYFDY (80) |
| | LC | RASQSVSSYLA (81) | DASYRAT (684) | QQRRNWPLT (686) |

TABLE 32-continued

CDR sequences of affinity-matured PSMA hits

| MAB ID | | CDR1 (SEQ ID NO:) | CDR2 (SEQ ID NO:) | CDR3 (SEQ ID NO:) |
|---|---|---|---|---|
| PSMB347 | HC | SDAMH (78) | EISGSGGYT NYADSMKS (2) | DSYDSSLYV GDYFDY (80) |
| | LC | RASQSVSSYLA (81) | DASNRAT (82) | QQRSNWPLT (83) |
| PSMB349 | HC | SDAMH (78) | EISGSGGYT NYADSLKG (3) | DSYDSSLYV GDYFDY (80) |
| | LC | RASQSVSSYLA (81) | DASNRAT (82) | QQRGNWPLT (5) |
| PSMB358 | HC | SDAMH (78) | EISGSGGYT NYADSLKG (3) | DSYDSSLYV GDYFDY (80) |
| | LC | RASQSVSSYLA (81) | DASNRAT (82) | QQRSNWPLT (83) |
| PSMB359 | HC | SDAMH (78) | EISGSGGYT NYADSLKG (3) | DSYDSSLYV GDYFDY (80) |
| | LC | RASQSVSNYLA (4) | DASNRAT (82) | QQRRNWPLT (686) |
| PSMB360 | HC | SDAMH (78) | EISGSGGYT NYADSLKG (3) | DSYDSSLYV GDYFDY (80) |
| | LC | RASQSVSSYLA (81) | DASYRAT (684) | QQRRNWPLT (686) |
| PSMB361 | HC | SDAMH (78) | EISGSGGYT NYADSMKS (2) | DSYDSSLYV GDYFDY (632) |
| | LC | RASQSVSSYLA (81) | DASNRAT (82) | QQRGNWPLT (5) |
| PSMB362 | HC | SDAMH (78) | EISGSGGYT NYADSMKS (2) | DSYDSSLYV GDYFDY (80) |
| | LC | RASQSVSNYLA (4) | DASNRAT (685) | QQRRNWPLT (686) |
| PSMB363 | HC | SDAMH (78) | EISGSGGYT NYADSMKS (2) | DSYDSSLYV GDYFDY (80) |
| | LC | RASQSVSSYLA (630) | DASYRAT (684) | QQRRNWPLT (686) |
| PSMB365 | HC | SDAMH (78) | EISGSGGYT NYADSLKS (683) | DSYDSSLYV GDYFDY (80) |
| | LC | RASQSVSSYLA (81) | DASYRAT (684) | QQRRNWPLT (686) |

3 Preparation and Functional Evaluation of PSMA×CD3 Bispecific Antibodies 3-1 Generation of PSMA×CD3 Bispecific Antibodies Two types of affinity-matured PSMA×CD3 bispecific antibodies were generated: one specific for the targeting arm (e.g. affinity matured anti-PSMA) recombined with a high affinity CD3 arm CD3B376 (VH SEQ ID NO:652, VL SEQ ID NO:661; HC SEQ ID NO:640, LC SEQ ID NO:676) CD3 arm or low affinity CD3B450 (VH SEQ ID NO: 657, VL SEQ ID NO: 678, HC SEQ ID NO:675, LC SEQ ID NO:677) arm.

These parental mAbs are in the GenMab format (Labrijn et al, 2013) where the targeting parent (PSMA) contains the 409R GenMab mutation (native amino acid for IgG4), while the killing parent (CD3) contains the F405L GenMab mutation and R409K mutation. The monospecific anti-CD3 antibody was expressed as IgG4, having Fc substitutions S228P, F234A, L235A, F405L, and R409K (CD3 arm) (numbering according to EU index) in their Fc regions. The targeting parent (PSMA) is on human IgG4 with Fc substitutions S228P, F234A, L235A. The monospecific antibodies were expressed in HEK cell lines under CMV promoters.

The parental PSMA and CD3 antibodies were purified using a protein A column with an elution buffer of 100 mM NaAc pH3.5 and a neutralization buffer of 2.5M Tris, pH 7.2. The neutralized parental mAbs were used to make PSMA×CD3 bispecific antibodies. A portion of parental mabs were further buffer exchanged into D-PBS, pH 7.2 buffer for analytical measurements and assays.

Post purification, controlled Fab-arm exchange was performed to make bispecific antibodies. The parental PSMA antibodies were mixed with the desired parental CD3 antibody under reducing conditions in 75 mM-2-MEA (2-Mercaptoethylamine) and incubated at 31° C. for 4h or at room temperature overnight. The recombination reactions were based on molar ratios, where 6% excess PSMA parental mAbs was used to minimize the CD3 parental mAb remaining after recombination. The recombinations were subsequently dialyzed against 1×DPBS, pH 7.2 to remove the reductant.

The final bispecific antibodies produced, along with the parental mAbs (i.e. PSMA, CD3, or Null) used in the recombination reactions are listed in Table 33.

Selected PSMA hits were also paired with a non-killing arm (Null) to create negative controls for testing purposes. For control bispecific antibodies, B2M1, an RSV antibody in the IgG4 PAA format (VH SEQ ID NO:610, VL SEQ ID NO:611) was generated, purified and, combined with either the CD3 arm CD3B219-F405L, R409K to generate CD3B288 (CD3×null) or PSMA arms, PSMB122, PSMB126, PSMB130 to generate PS3B37, PS3B39 and PS3B40 respectively (PSMA×null). These PSMA specific affinity matured Mabs were crossed (as in methods above) to CD3B219 and CD3B376 to generate the bispecific antibodies shown in Table 32.

TABLE 33

Generation of affinity-matured PSMA × CD3 bispecific antibodies generated from affinity matured PSMA hits

| ID | Arm 1 | HC | LC | Arm 2 | HC | LC |
|---|---|---|---|---|---|---|
| PS3B60 | PSMB344 | PSMH859 | PH9L3 | CD3B219 | CD3H141 | CD3L66 |
| PS3B61 | PSMB345 | PSMH859 | PSML159 | CD3B219 | CD3H141 | CD3L66 |
| PS3B62 | PSMB346 | PSMH859 | PSML160 | CD3B219 | CD3H141 | CD3L66 |
| PS3B63 | PSMB347 | PSMH860 | PH9L3 | CD3B219 | CD3H141 | CD3L66 |
| PS3B64 | PSMB349 | PSMH862 | PSML158 | CD3B219 | CD3H141 | CD3L66 |
| PS3B70 | PSMB358 | PSMH862 | PH9L3 | CD3B219 | CD3H141 | CD3L66 |
| PS3B71 | PSMB359 | PSMH862 | PSML159 | CD3B219 | CD3H141 | CD3L66 |
| PS3B72 | PSMB360 | PSMH862 | PSML160 | CD3B219 | CD3H141 | CD3L66 |
| PS3B73 | PSMB361 | PSMH860 | PSML158 | CD3B219 | CD3H141 | CD3L66 |
| PS3B74 | PSMB362 | PSMH860 | PSML159 | CD3B219 | CD3H141 | CD3L66 |
| PS3B75 | PSMB363 | PSMH860 | PSML160 | CD3B219 | CD3H141 | CD3L66 |
| PS3B76 | PSMB358 | PSMH862 | PH9L3 | CD3B376 | CD3H219 | CD3L150 |
| PS3B77 | PSMB349 | PSMH862 | PSML158 | CD3B376 | CD3H219 | CD3L150 |
| PS3B78 | PSMB359 | PSMH862 | PSML159 | CD3B376 | CD3H219 | CD3L150 |
| PS3B79 | PSMB360 | PSMH862 | PSML160 | CD3B376 | CD3H219 | CD3L150 |
| PS3B80 | PSMB347 | PSMH860 | PH9L3 | CD3B376 | CD3H219 | CD3L150 |
| PS3B81 | PSMB361 | PSMH860 | PSML158 | CD3B376 | CD3H219 | CD3L150 |
| PS3B82 | PSMB362 | PSMH860 | PSML159 | CD3B376 | CD3H219 | CD3L150 |
| PS3B83 | PSMB363 | PSMH860 | PSML160 | CD3B376 | CD3H219 | CD3L150 |
| PS3B84 | PSMB344 | PSMH859 | PH9L3 | CD3B376 | CD3H219 | CD3L150 |
| PS3B85 | PSMB345 | PSMH859 | PSML159 | CD3B376 | CD3H219 | CD3L150 |
| PS3B86 | PSMB346 | PSMH859 | PSML160 | CD3B376 | CD3H219 | CD3L150 |
| PS3B90 | PSMB365 | PSMH865 | PSML160 | CD3B376 | CD3H219 | CD3L150 |

3-2 Evaluation of PSMA×CD3 Affinity Matured Bispecific Abs in LNCAP Cell Binding PSMA×CD3 bispecific antibodies were tested for binding to PSMA positive cell line, LNCAP, to PSMA negative cell line, PC3. To assess the binding capabilities of the PSMA bispecific antibodies, the cell-binding assay was utilized (described previously). Bispecific antibodies were normalized for protein concentration and then incubated with the same number of cells expressing either human or cyno PSMA. The MFI at each concentration was collected by flow cytometry and plotted as a function of concentration. Data was transformed via log 10 and then plotted. Nonlinear regression of binding curves was done to determine EC50s. These relative values were used for ranking PSMA binding to target cells. FIGS. 14-16 show LNCAP binding of all bispecific antibodies prepared. In FIG. 16, none of the constructs demonstrated binding to the PSMA negative cell line. In FIG. 14 and FIG. 15, all of the affinity matured hits demonstrated increased binding affinity through left shifted curves and increased cMax as compared to the parental Mab, PS2B27.

The interactions of the affinity matured bispecific antibodies with recombinant Cyno PSMA ECD and Human PSMA ECD were studied by Surface Plasmon Resonance (SPR) using a ProteOn XPR36 system (BioRad) as described previously for recombinant chimp PSMA ECD. All of the bispecific antibodies bind both targets with substantially the same affinity, KDs ranging from 0.05 nM to 0.27 nM for human PSMA ECD and from 0.05 nM to 0.23 nM from cyno PSMA ECD.

3-3 Evaluation of PSMA×CD3 Affinity Matured Bispecific Abs in Functional Cell Killing Assay Based on the above data, affinity measurements, and sequence identity, three PSMA antibodies, PSMB347, PSMB360 and PSMB365 as bispecifics with either CD3B219 or CD3B376, were further characterized for the ability to mediate PSMA specific, redirected T cell cytotoxicity. T-cell mediated killing was measured using a caspase cytotoxicity assay, which indirectly measures cell killing via cleavage of a fluorescent substrate by active caspase 3/7. Cleavage of the substrate results in a fluorescent DNA dye, with fluorescence restricted to the cell nucleus. Repeated fluorescence measurements are taken in each well throughout the course of the assay, using a motorized 10× objective, capable of precisely imaging well(s) at the same coordinates. Target cell populations are identified based on defined size restrictions and/or through the use of a secondary label. Frozen Pan CD3+ T-cells (purchased from Biological Specialty Corporation, Colmar, Pa.) were isolated by negative selection from normal healthy donors. Prostate cancer cells, expressing PSMA, (LNCaP, C42) were cultured in RPMI 1640 with 10% HI FBS+supplements (purchased from Life Technologies).

T-cells and target cells were combined at an effector to target ratio (E:T) of 3:1 in Phenol Red free RPMI+10% FBS and supplements (Life Technologies), without selection reagents, and 0.6 uL of NucView caspase reagent (Essen Bioscience) was added to each mL of cells, per manufacturer guidelines. A total volume of 0.1 mL cells were added to appropriate wells of a clear, 96-well flat-bottom plate (BD Falcon). PS3B27 (CD3×PSMA), CD3B288 (CD3×Null) or PS3B46 (PSMA×Null) Bispecific antibodies were prepared at 2× final concentration in Phenol Red free RPMI, prepared as indicated above, and 0.1 mL of compounds were added to each well. After 30 minute incubation at room temperature to minimize cell aggregation at the edge of wells, plates were transferred to the Zoom Incucyte instrument (Essen Bioscience). The Incucyte Instrument resides in a humidified incubator set at 37° C., 5% CO2.

Processing definitions on the Incucyte were designed for each cell line tested, per manufacture guidelines. Measurements were taken every six hours, until a plateau in the caspase signal was observed, and followed by three or more successive decreases from the maximum signal in the well(s) containing the highest concentration of the test compound(s). As the data shows in FIG. 17, the curves for PS3B80, PS3B79, PS3B89, PS3B90, PS3B63, and PS3B72 are left shifted indicating increased potency over PS3B27. The null arm controls did not induce cell death as expected.

3-4 Anti-Tumor Efficacy in Tumorigenesis Prevention of LnCaP Xenografts in Humanized NSG Mice Efficacy of PS3B79 and PS3B90 was evaluated in established 3D LnCaP AR.TB human prostate cancer xenografts in male NOD.Cg-Prkd$^{scid}$ Il2rg$^{tm1Wjl}$/SzJ (NSG) mice humanized intraperitoneally (ip) with human T cells. PS3B79 and PS3B90 at 2.5 and 5 mg/kg or Null×CD3B376 antibody control was dosed q3d-q4d on Days 36, 39, 43, 47, 50, 53, 56, 60, and 63 for a total of 8 doses. On day 53 post-tumor implant, which was the last date of the study when nine (9) animals remained per group, tumor growth inhibition (% TGI) was calculated. Statistically significant tumor growth inhibition was observed for PS3B79 at 5 mg/kg with 42% TGI (Two-way ANOVA with Bonferroni test, *p<0.0001, FIG. 20), and for PS3B90 at 2.5 and 5 mg/kg with 53% and 33% respectively compared to Null× CD3 control (Two-way ANOVA with Bonferroni test, *p<0.001, FIG. 21). Thus, CD3B376 is able to induce T cell activation and cytotoxicity in vivo and result in tumor growth inhibition in a bispecific format with high affinity PSMA binding arms, PSMB360 and PSMB365.

4 Preparation and Functional Evaluation of IL1RAP× CD3 Bispecific Antibodies

IL1RAP monoclonal antibodies used in and suitable for use in the bispecific antibodies of the present disclosure are described in U.S. Patent Application Publication No. 20170121420A1, the disclosure of which is hereby incorporated by reference in its entirety. Fifteen monospecific IL1RAP antibodies (see Table 6 of US20170121420A1) were expressed as IgG4, having Fc substitutions S228P, L234A, and L235A. CD3 parental mAbs were expressed as IgG4 with S228P, L234A, L235A, F405L, and R409K (numbering according to EU index). A monospecific anti-CD3 antibody CD3B220 was also generated comprising the VH and VL regions having the VH of SEQ ID NO: 92 and the VL of SEQ ID NO: 93 and IgG4 constant region with S228P, L234A, L235A, F405L, and R409K substitutions.

The monospecific antibodies were purified using standard methods using a Protein A column. After elution, the pools were neutralized to pH 7 and dialyzed into 1×D-PBS, pH 7.2.

Bispecific IL1RAP×CD3 antibodies were generated by combining a monospecific CD3 mAb (CD3B376: VH of SEQ ID NO: 652 and VL of SEQ ID NO: 661; or CD3B450: VH of SEQ ID NO: 657 and VL of SEQ ID NO: 678) and a monospecific IL1RAP mAb through controlled Fab-arm exchange (as described in WO2011/131746). Briefly, at about 1-20 mg/mL at a molar ratio of 1.08:1 of anti-IL1RAP/anti-CD3 antibody in DPBS, pH 7-7.4 and 75 mM 2-mercaptoethanolamine (2-MEA) were mixed together and incubated at 25-37° C. for 2-6 hours, followed by removal of the 2-MEA via dialysis, diafiltration, tangential flow filtration to remove the reductant and enable bispecific antibody formation.

Heavy and light chains for the IL1RAP×CD3 bispecific antibodies are shown below in Table 34.

TABLE 34

CDR sequences of 15 IL1RAP mAbs selected for generation of IL1RAP × CD3 bispecific antibodies (SEQ ID NOs in parentheses).

| ID | HC-CDR1 | HC-CDR2 | HC-CDR3 | LC-CDR1 | LC-CDR2 | LC-CDR3 |
|---|---|---|---|---|---|---|
| IAPB47 | GYSFTSYW (152) | IYPSDSYT (153) | ARRNSAE NYADLDY (154) | QSISND (155) | YAS (156) | QQSFT APLT (157) |
| IAPB38 | GFTFSNYA (158) | INYGGGSK (159) | AKDYGPF ALDY (160) | QSVDDW (161) | TAS (162) | QQYHH WPLT (163) |
| IAPB57 | GGSISSST YY (164) | IYFTGST (165) | AKEDDSS GYYSFDY (166) | QGISSY (167) | AAS (168) | QQVNS YPLT (169) |
| IAPB61 | GVSISSST YY (170) | IYFTGNT (171) | GSLFGDY GYFDY (172) | QFISSN (173) | GAS (174) | QQYNN WPST (175) |
| IAPB62 | GYTFNTYA (176) | INTNTGNP (177) | ARRYFDW LLGAFDI (178) | QGISSW (179) | AAS (168) | QQANS FPLT (180) |
| IAPB3 | GGTFSSYA (181) | ISAIFGTA (182) | ARGNSFH ALWDYAF DY (183) | QSVLYSS NNKNY (184) | WAS (185) | QQYYS TPLT (186) |
| IAPB17 | GGTFSSYA (181) | IIPIFGNA (187) | ARTIIYL DYVHILD Y (188) | QSVLYSS NNKNY (184) | WAS (185) | QQYYS TPLT (186) |
| IAPB23 | GFTFSNYW (189) | IRYDGGSK (190) | AKDAYPP YSFDY (191) | QSVSSY (192) | DAS (193) | QQRSN WPLT (194) |
| IAPB25 | GFTFSSYA (195) | ISGSGGST (196) | AKGDEYY YPDPLDY (197) | QSISSY (198) | AAS (168) | QQSYS TPLT (199) |
| IAPB29 | GFTFSNYA (158) | ISGSGGST (196) | AKEWSSY FGLDY (200) | QSISSY (198) | AAS (168) | QQSYS TPLT (199) |
| IAPB9 | GGTFSSYA (181) | ISPIFGTA (201) | ARRYDNF ARSGDLD Y (202) | QSISSY (198) | AAS (168) | QQSYS TPLT (199) |
| IAPB55 | GVSISSST YY (170) | IYFTGNT (171) | GSLFGDY GYFDY (172) | QFISSN (173) | GAS (174) | QQYNN WPFT (203) |
| IAPB63 | GYTFNTYA (176) | INTNTGNP (177) | ARRYFDW LLGAFDI (178) | SSDVGDY NY (204) | DVS (205) | ASYAG NYNVV (206) |
| IAPB64 | GYTFNTYA (176) | INTNTGNP (177) | ARRYFDW LLGAFDI (178) | SSDVGDY NY (204) | DVS (205) | SSYAG NYNVV (207) |
| IAPB65 | GGTFSSYA (181) | ISAIFGTA (182) | ARHLHNA IHLDY (208) | QSVSNF (209) | GAS (174) | QQGKH WPWT (210) |

VH and VL sequences of the 15 IL1RAP mAbs are shown below in Table 35.

TABLE 35

VH and VL sequences of IL1RAP mAbs for generation of IL1RAP × CD3 bispecific antibodies.

| ID | VH Amino Acid Sequence | SEQ ID NO: | VL Amino Acid Sequence | SEQ ID NO. |
|---|---|---|---|---|
| IAPB47 | EVQLVQSGAEVKKPGESLKISCKGSGYSFTSYWIGWVRQMPGKGLEWMGIIYPSDSYTRYSPSFQGQVTISADKSISTAYLQWSSLKASDTAMYYCARRNSAENYADLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVKSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 211 | EIVLTQSPGTLSLSPGERATLSCRASQSISNDLNWYQQKPGKAPKLLIYYASSLQSGVPSRFSGSGSGTDFTLTINSLQPEDFATYYCQQSFTAPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 212 |
| IAPB38 | EVQLLESGGGLVQPGGSLRLSCAASGFTFSNYAMNWVRQAPGKGLEWVSGINYGGGSKYYADSVKGRFTISRDNSKNTLYLQMNSLRAEDTAVYYCAKDYGPFALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 213 | EIVLTQSPATLSLSPGERATLSCRASQSVDDWLAWYQQKPGQAPRLLIYTASNRATGIPARFSGSGSGTDFTLTISSLEPEDFAVYYCQQYHHWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 214 |
| IAPB57 | QLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSGYYSFDYWGQGNLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 215 | DIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 216 |
| IAPB61 | QLQLQESGPGLVKPSETLSLTCTVSGVSISSSTYYWGWLRQPPGMGLEWTGSIYFTGNTYYNPSLKSRVTISVDTSRNQFSLKLSSVTAADTAVYYCGSLFGDYGFYDWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 217 | EIVMTQSPATLSVSPGERATLSCRASQFISSNLAWYQQKPGQAPRLLIYGASTRATGIPARFSGSGSGTDFTLTISSLQSEDFAVYYCQQYNNWPSTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 218 |
| IAPB62 | QVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 219 | DIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 220 |
| IAPB3 | QVQLVQSGAEVKKPGSSVKVSCKASGGTFSSYAISWVRQAPGQGLEWMGGISAIFGTANYAQKFQGRVTITADESTSTAYMELSSLRSEDTAVYYCARGNSPHALWDYAFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEE | 221 | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 222 |

TABLE 35-continued

VH and VL sequences of IL1RAP mAbs for generation of IL1RAP x CD3 bispecific antibodies.

| ID | VH Amino Acid Sequence | SEQ ID NO: | VL Amino Acid Sequence | SEQ ID NO. |
|---|---|---|---|---|
| | MTKNQVSLTCLVKGFYPSDIAVEWESNGQPENNYKTTPPVLDSDGSFFLYSRLTVDKSRWQEGNVFSCSVMHEALHNHYTQKSLSLSLGK | | | |
| IAPB17 | QVQLVQSGAEVKKPGSSVKVSCKASGGTFSSYAISWVRQAPGQGLEWMGGIIPIFGNANYAQKFQGRVTITADESTSTAYMELSSLRSEDTAVYYCARTIIYLDYVHILDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 223 | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 222 |
| IAPB23 | EVQLLESGGGLVQPGGSLRLSCAASGFTFSNYWMNWVRQAPGKGLEWVSAIRYDGGSKYYADSVKGRFTISRDNSKNTLYLQMNSLRAEDTAVYYCAKDAYPPYSFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 224 | EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 225 |
| IAPB25 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGDEYYYPDPLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVYSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 226 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 227 |
| IAPB29 | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCAKEWSSYFGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 228 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 227 |
| IAPB9 | QVQLVQSGAEVKKPGSSVKVSCKASGGTFSSYAISWVRQAPGQGLEWMGWISPIFGTANYAQKFQGRVTITADESTSTAYMELSSLRSEDTAVYYCARRYDNFARSGDLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 229 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 227 |
| IAPB55 | QLQLQESGPGLVKPSETLSLTCTVSGVSISSSTYYWGWLRQPPGMGLEWTGSIYFTGNTYYNPSLKSRVTISVDTSRNQFSLKLSSVTAADTAVYYCGSLFGDYGYFDYWGQTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLEPPKP | 633 | EIVMTQSPATLSVSPGERATLSCRASQFISSNLAWYQQKPGQAPRLLIYGASTRATGIPARFSGSGSGTDFTLTISSLQSEDFAVYYCQQYNNWPFTFGQGTKVDIKRTVAAPSVFIFPPSDEQLKSGTASVVCLLNNFYPREAKVQWKVDNALQSGNSQESVTEQDSK | 230 |

TABLE 35-continued

VH and VL sequences of IL1RAP mAbs for generation of IL1RAP x CD3 bispecific antibodies.

| ID | VH Amino Acid Sequence | SEQ ID NO: | VL Amino Acid Sequence | SEQ ID NO. |
|---|---|---|---|---|
| | KDTLMISRTPEVTCVVDV SQEDPEVQFNWYVDGVEVH NAKTKPREEQFNSTYRVVS VLTVLHQDWLNGKEYKCKV SNKGLPSSIEKTISKAKGQ PREPQVYTLPPSQEEMTKN QVSLTCLVKGFYPSDIAVE WESNGQPENNYKTTPPVLD SDGSFFLYSRLTVDKSRWQ EGNVFSCSVMHEALHNHYT QKSLSLSLGK | | DSTYSLSSTLTLS KADYEKHKVYACE VTHQGLSSPVTKS FNRGEC | |
| IAPB63 | QVQLVQSGSELKKPGASVK VSCKASGYTFNTYAMNWV RQAPGQGLEWMGWINTNT GNPTYAQGFTGRFVFSLDT SVSTAYLQISSLKAEDTAV YYCARRYFDWLLGAFDIWG QGTMVTVSSASTKGPSVFP LAPCSRSTSESTAALGCLV KDYFPEPVTVSWNSGALTS GVHTFPAVLQSSGLYSLSS VVTVPSSSLGTKTYTCNVD HKPSNTKVDKRVESKYGPP CPPCPAPEAAGGPSVFLFP PKPKDTLMISRTPEVTCVV VDVSQEDPEVQFNWYVDGV EVHNAKTKPREEQFNSTYR VVSVLTVLHQDWLNGKEYK CKVSNKGLPSSIEKTISKA KGQPREPQVYTLPPSQEEM TKNQVSLTCLVKGFYPSDI AVEWESNGQPENNYKTTPP VLDSDGSFFLYSRLTVDKS RWQEGNVFSCSVMHEALHN HYTQKSLSLSLGK | 219 | QSALTQPRSVSGS PGHSVTISCTGTS SDVGDYNYVSWYQ QRPGKVPKLLIYD VSKRPSGVPDRFS GSKSGNTASLTIS GLQAEDEAIYFCA SYAGNYNVVFGGG TKLTVLGQPKAAP SVTLFPPSSEELQ ANKATLVCLISDF YPGAVTVAWKADS SPVKAGVETTTPS KQSNNKYAASSYL SLTPEQWKSHRSY SCQVTHEGSTVEK TVAPTECS | 231 |
| IAPB64 | QVQLVQSGSELKKPGASVK VSCKASGYTFNTYAMNWV RQAPGQGLEWMGWINTNT GNPTYAQGFTGRFVFSLDT SVSTAYLQISSLKAEDTAV YYCARRYFDWLLGAFDIWG QGTMVTVSSASTKGPSVFP LAPCSRSTSESTAALGCLV KDYFPEPVTVSWNSGALTS GVHTFPAVLQSSGLYSLSS VVTVPSSSLGTKTYTCNVD HKPSNTKVDKRVESKYGPP CPPCPAPEAAGGPSVFLFP PKPKDTLMISRTPEVTCVV VDVSQEDPEVQFNWYVDGV EVHNAKTKPREEQFNSTYR VVSVLTVLHQDWLNGKEYK CKVSNKGLPSSIEKTISKA KGQPREPQVYTLPPSQEEM TKNQVSLTCLVKGFYPSDI AVEWESNGQPENNYKTTPP VLDSDGSFFLYSRLTVDKS RWQEGNVFSCSVMHEALH NHYTQKSLSLSLGK | 219 | QSALTQPRSVSGS PGHSVTISCTGTS SDVGDYNYVSWYQ QRPGKVPKLLIYD VSKRPSGVPDRFS GSKSGNTASLTIS GLQAEDEAIYFCS SYAGNYNVVFGGG TKLTVLGQPKAAP SVTLFPPSSEELQ ANKATLVCLISDF YPGAVTVAWKADS SPVKAGVETTTPS KQSNNKYAASSYL SLTPEQWKSHRSY SCQVTHEGSTVEK TVAPTECS | 232 |
| IAPB65 | QVQLVQSGAEVKKPGSSVK VSCKASGGTFSSYAISWVR QAPGQGLEWMGGISAIFGT ANYAQKFQGRVTITADEST STAYMELSSLRSEDTAVYY CARHLHNAIHLDYWGQGT LVTVSSASTKGPSVPPLAP CSRSTSESTAALGCLVKDY FPEPVTVSWNSGALTSGVH TFPAVLQSSGLYSLSSVVT | 233 | EIVLTQSPATLSL SPGERATLSCRAS QSVSNFLAWYQQK PGQAPRLLIYGAS NRATGIPARFSGS GSGTDFTLTISSL EPEDFAVYYCQQG KHWPWTFGQGTKV EIKRTVAAPSVFI FPPSDEQLKSGTA | 234 |

TABLE 35-continued

VH and VL sequences of IL1RAP mAbs for generation of IL1RAP x CD3 bispecific antibodies.

| ID | VH Amino Acid Sequence | SEQ ID NO: | VL Amino Acid Sequence | SEQ ID NO. |
|---|---|---|---|---|
| | VPSSSLGTKTYTCNVDHKP SNTKVDKRVESKYGPPCPP CPAPEAAGGPSVFLFPPKP KDTLMISRTPEVTCVVVDV SQEDPEVQFNWYVDGVEVH NAKTKPREEQFNSTYRVVS VLTVLHQDWLNGKEYKCKV SNKGLPSSIEKTISKAKGQ PREPQVYTLPPSQEEMTKN QVSLTCLVKGFYPSDLAVE WESNGQPENNYKTTPPVLD SDGSFFLYSRLTVDKSRWQ EGNVFSCSVMHEALHNHYT QKSLSLSLGK | | SVVCLLNNFYPRE AKVQWKVDNALQS GNSQESVTEQDSK DSTYSLSSTLTLS KADYEKHKVYACE VTHQGLSSPVTKS FNRGEC | |

4-1 Evaluation of IL1RAP Bispecific Antibodies in a Whole Blood T Cell Cytotoxicity Assay Methods: Tumor cell line LAMA-84 was washed with DPBS before incubation with CFSE (resuspended in 150 µL DMSO and diluted 1:10,000) at $10 \times 10^6$ cells/mL of CFSE for 8 minutes at room temperature. Staining was quenched with HI FBS and washed in media before resuspension in complete media at $2 \times 10^5$ cells/mL. Equal volumes of whole blood and CFSE-stained tumor cells were combined in each well of a 96-well plate. After the addition of antibody (resuspended in 10 µL of DPBS) in respective wells, all plates were incubated at 37° C. with 5% $CO_2$ for 48 hours. Undiluted CD25-PE was added directly to each well of whole blood and incubated for 30 minutes at room temperature, protected from light. Cells were then centrifuged at 1500 rpm for 5 minutes and lysed with 200 uL of multi-specie red lysis buffer, repeated 4 more times. Cells were washed in DPBS once and stained with Live/Dead Near-IR (diluted in DPBS) for 15 minutes (Table 36). Each well was washed and resuspended in FACS buffer before the cells were acquired on a BD FACS CANTO II.

TABLE 36

Whole Blood T cell cytotoxicity staining panel

| Antigen | Channel | Clone | Dilution | Source | Catalog # |
|---|---|---|---|---|---|
| CD25 | PE | BC96 | 1:100 | Biolegend | 302606 |
| CD4 | PerCP | RPA-T4 | 1:100 | Biolegend | 300528 |
| CD8 | APC | HIT8a | 1:100 | Biolegend | 300912 |
| Live/Dead | APC-Cy7 | NA* | 1:200 | Invitrogen | L34976 |

*NA = not applicable

The cell acquisition on the FACS CANTO II (Becton, Dickinson and Company, Franklin Lakes, N.J.) was limited to $1 \times 10^4$ tumor cells. Tumor cell death was assessed by gating on FSC and SSC to identify cell populations, then CFSE positive tumor events, and finally Live/Dead Near-IR to assess tumor cytotoxicity. T-cell activation was assessed by gating on FSC and SSC to identify cell populations, CFSE negative events, Near-IR negative events to assess live cells, then CD25 positive cells. The percentage of either dead tumor cells or CD25 positive cells were graphed using GraphPad Prism 6 and analyzed with a non-linear curve fit. Additional statistical analysis was evaluated in the program "R" to determine population $EC_{50}$ values using a nonlinear mixed-effects model.

Results: To mimic physiological peripheral whole blood conditions containing sIL1RAP, IC3B19 (IAPB57×CD3B219) and IC3B34 (IAPB57×CD3B376) were evaluated in an ex vivo T cell redirection assay utilizing whole blood. Exogenously added IL1RAP+ LAMA-84 cell line ($2 \times 10^4$ cells/well) was added to healthy control human peripheral whole blood (n=15 donor samples) with IC3B19, IC3B34, and null arm control bispecific antibodies for 48 hours. As shown in FIG. 52, IC3B19 and IC3B34 induced similar T-cell mediated cytotoxicity of IL1RAP+ LAMA-84 cell line ex vivo after 48 hours. The $EC_{50}$ values for IC3B19 and IC3B34 cytotoxicity, represented FIG. 52 were 2.097 and 2.762, respectively (Table 37). Similarly, the $EC_{50}$ values for T-cell activation (CD25) by IC3B19 and IC3B34 represented by FIG. 53 were 4.237 and 7.825 nM, respectively (Table 38). All of the null arm control bispecific antibodies did not induce detectable levels of cytotoxicity or T-cell activation as shown in FIG. 52 and FIG. 53. The general level of cytotoxicity and T-cell activation were similar between both IC3B19 and IC3B34.

TABLE 37

IC3B19 and IC3B34 Cytotoxicity EC50 (nM)
Concentrations in the LAMA-84 cell line

| Effective Concentration (nM) | IC3B19 | IC3B34 |
|---|---|---|
| $EC_{50}$ | 2.097 | 2.762 |

TABLE 38

IC3B19 and IC3B34 T-cell Activation EC50 (nM)
Concentrations in the LAMA-84 cell line

| Effective Concentration (nM) | IC3B19 | IC3B34 |
|---|---|---|
| EC50 | 4.237 | 7.825 |

4-2 Evaluation of Cytokine Release by IL1RAP×CD3 Bispecific Abs in a Whole Blood T Cell Cytotoxicity Assay at 24 and 48 Hours Methods: Frozen supernatants from 24 hour and 48 hour samples from Example 4-1 were thawed on wet ice. Prior to use, plates were centrifuged at 500 g for 5 minutes at 4° C., then placed back on wet ice. Serial dilutions were prepared in U-bottom 96-well plates (Falcon), using MSD Diluent 2 at 1:2, 1:25, and 1:1000 dilution ratios for ELISA.

While supernatants were being centrifuged, MSD Assay Plates (ProInflammatory Panel I V-Plex, Catalog #K15049G-4, Lot #K008572) were pre-washed per manufacturer's protocol. A standard curve was prepared by reconstituting the provided calibrator in 1.0 mL of MSD Diluent 2. Fifty microliters of each sample or standard was added directly to pre-washed MSD plates. Subsequent incubations and washes were all carried out per manufacturer's protocol. Assay plates were read on the MSD Sector Imager.

Two methods were used to compare response between IC3B19 and IC3B34:

Linear Regression with Mixed Effects

In this method, a linear regression model with fixed effects for compound, dose, and compound by dose interaction and random effects that take into account the paired donors was constructed. Post-hoc comparisons were then between IC3B19 and IC3B34 were made at each concentration and p-values were appropriately adjusted for multiple comparisons.

Non-Linear (Four-Parameter) Regression with Mixed Effects

IC3B19 and IC3B34 were modeled together using a non-linear regression model, with fixed effect parameters for minimum, maximum, log EC50, and slope for each compound, and a random effect term that takes into account paired donor effect. Point estimates and their confidence intervals were extracted and plotted for visual comparison from these separate models. Testing significant differences for each parameter was done by constructing a model that used a joint estimate for the parameter of interest, then comparing that model to the original model using a log-likelihood test. To elaborate, there is a model with parameters for IC3B19 minimum, IC3B19 maximum, IC3B19 log EC50, IC3B19 slope, IC3B34 minimum, IC3B34 maximum, IC3B34 log EC50, and IC3B34 slope. To check whether the minimums are the significantly different, a second model is constructed that has all the same parameter except that there is a single shared parameter for the minimum. The log likelihood (an overall measure of how well the model fits the data) of the first model is compared to the log likelihood of the second model. If they are not significantly different from each other, then we can conclude that the minimums are not significantly different from each other. Similarly, if the log likelihoods are significantly different from one another, then we would conclude that the minimums are significantly different.

In a number of cases, models or parameter comparisons were inestimable for one of two reasons: 1. the data was to intractable to calculate the four-parameter logistic regression itself, or 2. the difference between the parameter estimates was so large that is caused the joint model to fail. In the first case, results are not reported and in the summary table they are indicated with "NA". In the second, results are also not reported, but they are indicated in the summary table as "Sig.", as short-hand for significant. As the 95% confidence intervals around these parameters are individually estimable and do not overlap, we can consider them significantly different but the exact p-value is unknown.

Differences are considered statistically significant at p-value less than or equal to 0.05. All analyses were conducted in R, version 3.3.2.

Results: IC3B19 and IC3B34 mediated engagement of T cells and IL1RAP+ target cell line LAMA-84 (endogenous and exogenously added tumor cells) resulted in T cell cytokine release. To determine cytokine release difference between IC3B19 and IC3B34, supernatants were evaluated for 10 pro-inflammatory cytokines from whole blood (n=15 donors) cytotoxicity and T-cell activation assays with exogenous LAMA-84 IL1RAP+ tumor cell line added, as discussed in section example 1. Of the 10 cytokines evaluated, most cytokines resulted in a measurable dose dependent release in response to both IC3B19 and IC3B34, except for IL-8 and IL-12p70. As shown in Table 39, IL-10, IL-2, TNF-α, and INF-7 resulted in the most potent EC50 (nM) release. In addition, the majority of cytokines and at both time points, the IC3B34 molecule resulted in a less potent EC50 (nM) that was statistically significant. The exception were, IL-4 (24 hours), IL-6 (24 and 48 hours), IL-8 (24 and 48 hours), IL-12p70 (24 and 48 hours), IL-13 (24 hours), INF-7 (24 and 48 hours), and TNF-α (24 hours), which did not have a statistically significant difference in EC50 (nM) values between IC3B19 and IC3B34.

TABLE 39

IC3B19 and IC3B34 Four Parameter Logistic Regression Summary Table.
Bold text denotes statistical significant difference in EC50 (nM)
values between IC3B19 and IC3B34. Results of individual cytokine
release experiments are shown in the FIG. Nos. indicated.

| Cytokine | FIG. No. | Experiment | EC50 | Slope | Minimum | Maximum |
|---|---|---|---|---|---|---|
| IL-1beta | FIG. 36 | 24 hours | 0.0027 | 0.3046 | 0.0268 | 0.2033 |
| IL-1beta | FIG. 37 | 48 hours | 0.0010 | 0.3951 | 0.2543 | 0.0528 |
| IL-2 | FIG. 38 | 24 hours | 0.0001 | 0.0256 | 0.3103 | 0.6466 |
| IL-2 | FIG. 39 | 48 hours | Sig. | 0.2079 | 0.0158 | 0.0008 |
| IL-4 | FIG. 40 | 24 hours | 0.2415 | 0.4668 | 0.2942 | 0.0043 |
| IL-4 | FIG. 41 | 48 hours | NA | NA | NA | NA |
| IL-6 | FIG. 42 | 24 hours | Sig. | 0.0819 | 0.1151 | 0.5224 |
| IL-6 | FIG. 43 | 48 hours | NA | NA | NA | NA |
| IL-8 | FIG. 44 | 24 hours | NA | NA | NA | NA |
| IL-8 | FIG. 45 | 48 hours | NA | NA | NA | NA |
| IL-10 | FIG. 46 | 24 hours | <0.0001 | 0.0010 | 0.3406 | 0.7036 |
| IL-10 | FIG. 47 | 48 hours | <0.0001 | 0.2702 | 0.0011 | 0.0004 |
| IL-12p70 | FIG. 48 | 24 hours | NA | NA | NA | NA |
| IL-12p70 | FIG. 49 | 48 hours | NA | NA | NA | NA |
| IL-13 | FIG. 50 | 24 hours | NA | NA | NA | NA |
| IL-13 | FIG. 51 | 48 hours | 0.0106 | 0.8268 | <0.0001 | <0.0001 |
| IFN-gamma | FIG. 52 | 24 hours | 0.0065 | 0.6920 | 0.4644 | 0.3179 |
| IFN-gamma | FIG. 53 | 48 hours | 0.0266 | 0.1678 | 0.2695 | 0.0319 |
| TNF-alpha | FIG. 54 | 24 hours | 0.0016 | 0.0128 | 0.1443 | 0.7895 |
| TNF-alpha | FIG. 55 | 48 hours | 0.0004 | 0.5553 | 0.0043 | 0.5216 |

4-3 Evaluation of IL1RAP Bispecific Antibodies in a Caspase Cytotoxicity Assay

T-cell mediated killing of IC3B19 and IC3B34 was measured using a second type of cell toxicity assay. The caspase cytotoxicity assay indirectly measures cell killing via cleavage of a fluorescent substrate by active caspase 3/7. Cleavage of the substrate results in a fluorescent DNA dye, with fluorescence restricted to the cell nucleus. Repeated fluorescence measurements are taken in each well throughout the course of the assay, using a motorized 10× objective, capable of precisely imaging well(s) at the same coordinates. Target cell populations are identified based on defined size restrictions.

Frozen Pan CD3+ T-cells (purchased from Biological Specialty Corporation, Colmar, Pa.) were isolated by negative selection from normal healthy donors. Target cells (NCI-H1975 cells, a human lung adenocarcinoma cell line expressing IL1RAP), were cultured in RPMI 1640/Glutamax (25 mM HEPES buffer) medium supplemented with 10% heat inactivated FBS, 1 mM sodium pyruvate, and 0.1 mM non-essential amino acids (Life Technologies).

Target cells were plated at 20,000 cells/well in 50 ul of phenol-red free RPMI media containing supplements 16 hours prior to experiment initiation into tissue culture-treated, clear flat bottom plates (Costar). The cells were allowed to incubate at room temperature (RT) for 20 min to allow for even distribution of cells in the wells, and then the cells were allowed to incubate at 37° C. and 5% CO2 overnight.

On the day of the experiment, T-cells were counted and diluted to 1.0*10^6 cells/ml in phenol red free RPMI media containing supplements and combined with Nuc-View TM488 Caspase-3/7 Substrate (Essen Biosciences) for a working concentration of 10 uM. 100 ul of the combined T-cells and the Caspase-3/7 substrate were added to each well for a final concentration of 5 uM of the Caspase-3/7 substrate.

IC3B19 (IAPB57×CD3B219), IC3B34 (IAPB57× CD3B376), CD3B288 (Null×CD3B219), and IAPB57×Null (IAPB101) bispecific antibodies were prepared at 4× final concentration in phenol red free RPMI media containing supplements and 50 uL of the antibodies were added to each well. After a 20 min incubation at RT to allow for even distribution in the wells, plates were transferred to the Zoom Incucyte instrument (Essen Bioscience). The Incucyte Instrument resides in a humidified incubator set at 37° C., 5% $CO_2$.

A processing definition on the Incucyte was designed for the NCI-H1975 cells. This processing definition clearly identifies caspase activity of target cells, while excluding the T-cells by size. Measurements were taken at T0 and every six hours for up to 120 hours. The maximum signal was determined to be at 72 hours post treatment at which time the data was analyzed.

After the assay was complete, each plate was analyzed using the NCI-H1975 processing definition. Raw fluorescent data was exported from the Incucyte Zoom software, and pasted into GraphPad Prism (GraphPad Software, Inc., La Jolla, Calif.). Caspase 3/7 activity was determined by calculating the area under the curve (AUC) for each well in GraphPad. AUC values were plotted as a function of Log 10 nM antibody concentrations. The EC50 for each concentration response curve, in nanomolar (nM), was reported following non-linear regression (Sigmoidal dose-response-variable slope). Each assay contained two technical replicates and four measurements within each technical replicate.

Both IC3B19 and IC3B34, but not the bispecific antibodies with null arms (IAPB57×B23B49 or B23B39× CD3B219), induced target specific cytoxicity in NCI-H1975 cells (FIG. 56). In this assay, the cytotoxicity EC50s vary three-fold between IC3B19 and IC3B34, with values of 0.018 and 0.057 nM, respectively.

4-4 Efficacy of IAPB57×CD3B376 in H1975 Human NSCLC Xenografts in T Cell Humanized NSG Mice Efficacy of IAPB57×CD3B376 bispecific antibody IC3B34 was evaluated in established H1975 human Non-small cell lung cancer (NSCLC) xenografts in female NOD.Cg-Prkdcscid Il2rgtm1Wj1/SzJ (NSG) mice humanized with human T cells. IAPB57×CD3B376 at 0.1, 0.35 or 1 mg/kg or Null×CD3 antibody control was dosed on Days 14, 18, 21 and 25 for a total of 4 doses. On day 29 post-tumor implant, which was the last date of the study when ten animals remained per group, tumor growth inhibition (% TGI) was calculated. Statistically significant tumor growth inhibition was observed with IAPB57×CD3B376 at 0.35 and 1 mg/kg with 63% and 89% TGI, respectively compared to Null×CD3 control (Two-way ANOVA with Bonferroni test, p<0.0001, FIG. 57).

5 CD33 Antibodies 5-1 Antigen Generation

The human and cyno CD33 proteins were produced with or without a mutated monomeric form of human serum albumin (HSA), Uniprot P02768 with a C58S mutation, fused at the C-terminus for immunizations and assays. The cDNAs encoding the CD33 protein antigens with a six-histidine tag (SEQ ID NO: 596) were synthetically synthesized and cloned into a mammalian secretion expression vector under the Actin promoter using standard molecular biology techniques.

The full-length human CD33 extracellular domain (ECD) derived from Uniprot P20138 (SEQ ID NO:235) (human CD33 ECD) was fused at the N-terminus with a signal sequence and with or without the HSA, followed by a six histidine tag (SEQ ID NO: 596) at the C-terminus, (hCD33 ECD with HSA and hCD33 ECD only). The human CD33 ECD expression construct was transiently transfected into HEK293 derived cells, Expi293 (Gibco/Thermo Fisher Scientific; Waltham, Mass.) using Expifectamine according to manufacturer protocol. Cells were incubated 5 days at 37° C. with 8% $CO_2$ on an orbital shaker before harvesting. The expressed cells were removed by centrifugation and the soluble CD33 was purified from the media using immobilized metal affinity chromatography using Ni Sepharose 6 Fast Flow resin (GE Healthcare; Little Chalfont, United Kingdom) followed by Superdex 200 preparative size exclusion chromatography (SEC) (GE Healthcare) in Dubelcco's Phosphate Saline buffer pH 7.2 (1×DPBS). SEC elution fractions excluding any disulfide aggregates were combined and sterile filtered to yield the final protein for immunization and CD33 assays. Protein concentration was determined by A280 and quality of purified protein was assessed by SDS-PAGE and analytical SEC (Phenomenex; Torrance, Calif.). Endotoxin measurements were performed using EndoSafe-PTS Cartridges, a chromogenic LAL assay (Charles River; Wilmington, Mass.).

The human CD33 ECD subdomain proteins, hCD33 V-domain-HSA, hCD33 V-domain-his, hCD33 C2 domain-HSA, and hCD33 C2 domain-His, were similarly constructed, expressed and purified as the full-length human CD33 ECD.

Cyno CD33 constructs for immunization and cross selectivity assays, cyno CD33 ECD-HSA, cyno CD33-His, were also generated based on the Genbank sequence XP_005590138.1. Cyno CD33 protein expression and purification were same as the human CD33 proteins.

The CD33 antigens for screening were biotinylated in 50 mM Na Phosphate pH 7.2 using SureLink Chromagenic Biotin Labeling kit (SeraCare KPL) according to manufacturer conditions. Briefly, a biotin stock of 25 mM was added to the CD33 protein at a 4:1 molar ratio of biotin to protein and incubated at room temperature for 30 minutes with gentle rotation and then switched to 4° C. for 2 more hours. Unincorporated biotin was removed by buffer exchange into 1×DPBS. Protein concentration and biotin incorporation was determined by measuring at A280 nm and A354 nm using NanoDrop. See Table 40 for the sequences of each of the antigens described above.

TABLE 40

Antigen Sequences

| Protein Name | Protein ID | SEQ ID NO |
| --- | --- | --- |
| Cyno CD33 ECD-HSA | C33W1 | 236 |
| Human CD33 ECD-HSA | C33W2 | 237 |
| Human CD33-V-HSA | C33W3 | 238 |
| Human CD33-C2-HSA | C33W4 | 239 |
| Human CD33-V-His | C33W8 | 240 |
| Human CD33 C2-His | C33W9 | 241 |
| Human CD33 ECD-His | C33W49 | 242 |
| Cyno CD33 ECD-His | C33W50 | 243 |
| Human CD33 full length | | 244 |
| Cyno CD33 full length | | 245 |

5-2 Generation of CD33 Expressing Isogenic Cell Lines

Human and cyno CD33 expressing cell lines were generated using lentivirus (Genecopoeia; Rockville, Md.) containing full length human CD33 or cyno CD33 and puromycin for selection of CD33 positive cells. HEK293F cells (ATCC), negative for CD33, were transduced with lentiviral particles to overexpress human CD33 and cyno CD33. Following transduction, cells positively expressing CD33 and the resistance marker, were selected by treating pooled cells, grown in DMEM+10% HI FBS (Life Technologies; Carlsbad, Calif.) and supplemented with varying concentrations of Puromycin (Life Technologies).

In addition to the HEK generated cell lines, several commercial cell lines were used for binding and cellular toxicity assays. These included MOLM13, KG1, SH2, OCIAML3 and MV411 and were obtained from either American Type Culture Collection or Deutsche Sammlung von Mikrooranismen und Zellkulturen, and cultured at 37° C., 5% $CO_2$ in complete RPMI culture media with 10% FBS.

5-3 Immunization Campaigns

OmniRat

A human immunoglobulin transgenic rat strain (OmniRat®; Ligand Pharmaceuticals; San Diego, Calif.) was used to develop human CD33 monoclonal antibody expressing hybridoma cells. The OmniRat® contains a chimeric human/rat IgH locus (comprising 22 human $V_H$s, all human D and $J_H$ segments in natural configuration linked to the rat $C_H$ locus) together with fully human IgL loci (12 Vκs linked to Jκ-Cκ and 16 Vλs linked to Jλ-Cλ) (see e.g., Osborn, et al. (2013) J Immunol 190(4): 1481-1490). Accordingly, the rats exhibit reduced expression of rat immunoglobulin, and in response to immunization, the introduced human heavy and light chain transgenes undergo class switching and somatic mutation to generate high affinity chimeric human/rat IgG monoclonal antibodies with fully human variable regions. The preparation and use of OmniRat®, and the genomic modifications carried by such rats, is described in PCT Publication WO 2014/093908 to Bruggemann et al.

When immunized with recombinant human and cynomolgus CD33 (huCD33 ECD-HSA and cyno CD33 ECD-HSA respectively), this transgenic rat produces chimeric human-rat IgG antibodies to human CD33, some of which also bind to cynomolgus CD33.

Eight OmniRats were immunized alternately with huCD33 ECD-HSA and cyno CD33 ECD-HSA. Following a 46 day immunization regimen, lymph nodes from all eight OmniRats were harvested and used to generate hybridomas. Eighty-one 96-well plates of hybridoma supernatants were screened via binding ELISA and AlphaLISA using standard techniques, of which 128 hybridoma supernatants were selected for specific binding to huCD33 ECD-HSA and cyno CD33 ECD-HSA. Most of the 128 supernatants were also positive for binding to cells over-expressing huCD33 or cyCD33.

Six additional OmniRats were immunized with rhuCD33 only. Following a 31 day immunization regimen, lymph nodes from all six OmniRats were harvested and used to generate hybridomas. Thirty 96-well plates of hybridoma supernatants were screened via binding ELISA using standard techniques, of which 94 hybridoma supernatants were selected for specific binding to huCD33 ECD-HSA and cyno CD33 ECD-HSA. Hybridoma lysates were prepared from the positive clones and progressed to v region cloning described below.

OmniMouse

A human immunoglobulin transgenic mouse strain (OmniMouse®; Ligand Pharmaceuticals) was used to develop human CD33 monoclonal antibody expressing hybridoma cells. The OmniMouse® contains chimeric human/rat IgH loci together with fully human IgL loci. The mice exhibit reduced expression of mouse immunoglobulin, and in response to immunization, the introduced human heavy and light chain transgenes undergo class switching and somatic mutation to generate high affinity chimeric human/rat IgG monoclonal antibodies with fully human variable regions.

When immunized with recombinant human and cynomolgus CD33 (huCD33 ECD-HSA and cyno CD33 ECD-HAS respectively), this transgenic mouse produces chimeric human/rat IgG antibodies to human CD33, some of which also bind to cynomolgus CD33.

Four OmniMice were immunized alternately with huCD33 ECD-HSA and cyno CD33 ECD-HSA. Following a 53 day immunization regimen, spleens and lymph nodes from all four OmniMice were harvested and used to generate hybridomas. Forty-eight 96-well plates of hybridoma supernatants were screened via binding ELISA and AlphaLISA, of which 8 hybridoma supernatants were selected for specific binding to huCD33 ECD-HSA and cyno CD33 ECD-HSA. Hybridoma lysates were prepared from the positive clones and progressed to v region cloning described below.

V Region Cloning

Total RNA from hybridoma cell lysates was purified using RNeasy 96 kit (Qiagen; Hilden, Germany) following the manufacturer's protocol, and the resulting RNA was quantitated using Drop Sense and stored at −80° C. or cDNA was synthesized using Invitrogen SuperScript III First-Strand Synthesis System for RT-PCR (Invitrogen; Carlsbad, Calif.). The first strand cDNA Synthesis was carried out using gene specific primers annealed to the constant regions of heavy, kappa, and lambda chains, respectively. The RT-PCR reaction mixture is comprised of up to 3 μg of purified RNA, gene specific primer, dNTP mix, reaction buffer, 25 mM $MgCl_2$, DTT, RNaseOUT™ (40 U/μl, Invitrogen), and SuperScript™ III RT (200 U/μl, Invitrogen Cat #18080-051), and incubate at 50° C. for 50 minutes and 85° C. for 5 minutes. The resulting single-stranded cDNA was stored at −20° C., or the single-stranded DNA was PCR amplified. The PCR reaction was carried out using Platinum Pfx polymerase (Invitrogen). The v-region fragments were amplified by forward and reverse primers annealing to the leader sequences and constant regions of heavy, kappa and lambda chains, respectively, using optimized PCR conditions. The resulting PCR fragments were run on the gel and sequenced using pre-designed primers to obtain v-region sequences. The resulting .abi files of v-region sequences were collected and analyzed by the Sanger v-region sequence analysis program created at Janssen Biologics Discovery. The AA sequences of the recovered v-regions were registered in the internal database, codon optimized and cloned into the pUnder-based expression vector carrying the appropriate constant region of the desired human antibody isotype: IgG1 F405L and IgG4 PAA. A total of 76 OMNIRat antibodies and 8 OMNIMouse antibodies were successfully cloned and proceeded for further characterization. The tables below summarize the sequences from the top 32 identified in the OMNIRat campaigns (see Table 41) and the 8 identified in the OMNIMouse campaign (see Table 42) with several of the OMNIRat antibodies cloned into IgG1 as well as IgG4 PAA and all from the OMNIMouse campaign were cloned into both IgG1 and IgG 4 PAA.

TABLE 41

Antibody sequences identified via CD33 immunization in OMNIRat

| mAb | HC ID | HC Isotype | LC ID |
|---|---|---|---|
| C33B46 | C33H108 | huIgG1F405L | C33L74 |
| C33B48 | C33H80 | huIgG1F405L | C33L73 |
| C33B52 | C33H42 | huIgG1F405L | C33L8 |
| C33B54 | C33H44 | huIgG1F405L | C33L10 |
| C33B55 | C33H45 | huIgG1F405L | C33L11 |
| C33B56 | C33H46 | huIgG1F405L | IAPL24 |
| C33B61 | C33H48 | huIgG1F405L | C33L58 |
| C33B62 | C33H49 | huIgG1F405L | C33L59 |
| C33B63 | C33H51 | huIgG1F405L | C33L34 |
| C33B64 | C33H52 | huIgG1F405L | N46L109 |
| C33B66 | C33H55 | huIgG1F405L | C33L42 |
| C33B72 | C33H65 | huIgG1F405L | C33L47 |
| C33B73 | C33H66 | huIgG1F405L | C33L60 |
| C33B75 | C33H70 | huIgG1F405L | N46L109 |
| C33B77 | C33H72 | huIgG1F405L | C33L40 |
| C33B79 | C33H74 | huIgG1F405L | C33L38 |
| C33B80 | C33H76 | huIgG1F405L | C33L39 |
| C33B82 | C33H78 | huIgG1F405L | C33L57 |
| C33B83 | C33H81 | huIgG1F405L | C33L53 |
| C33B87 | C33H87 | huIgG1F405L | C33L35 |
| C33B88 | C33H88 | huIgG1F405L | C33L61 |
| C33B89 | C33H90 | huIgG1F405L | C33L51 |
| C33B94 | C33H98 | huIgG1F405L | C33L69 |
| C33B95 | C33H98 | huIgG1F405L | IAPL24 |
| C33B96 | C33H99 | huIgG1F405L | C33L37 |
| C33B101 | C33H69 | huIgG1F405L | C4LL152 |
| C33B107 | C33H68 | huIgG1F405L | C33L17 |
| C33B120 | C33H87 | huIgG1F405L | C33L41 |
| C33B122 | C33H92 | huIgG1F405L | C33L30 |
| C33B123 | C33H91 | huIgG1F405L | C33L44 |
| C33B124 | C33H73 | huIgG1F405L | C33L32 |
| C33B125 | C33H84 | huIgG1F405L | C33L66 |
| C33B760 | C33H45 | huIgG4 PAA | C33L11 |
| C33B777 | C33H65 | huIgG4 PAA | C33L47 |
| C33B778 | C33H66 | huIgG4 PAA | C33L60 |
| C33B782 | C33H72 | huIgG4 PAA | C33L40 |
| C33B792 | C33H87 | huIgG4 PAA | C33L35 |
| C33B799 | C33H98 | huIgG4 PAA | C33L69 |
| C33B806 | C33H69 | huIgG4 PAA | C4LL152 |
| C33B830 | C33H84 | huIgG4 PAA | C33L66 |
| C33B836 | C33H80 | huIgG4 PAA | C33L73 |
| C33B937 | C33H66 | huIgG4 PAA | C33L132 |

HC: Heavy Chain;
LC: Light Chain

TABLE 42

Antibody sequences identified via CD33 immunization in OMNIMouse

| mAb | HC ID | LC ID |
|---|---|---|
| C33B901 | C33H249 | C33L115 |
| C33B902 | C33H250 | C33L116 |
| C33B903 | C33H251 | C33L117 |
| C33B904 | C33H252 | C33L118 |
| C33B905 | C33H253 | C33L119 |

TABLE 42-continued

Antibody sequences identified via
CD33 immunization in OMNIMouse

| mAb | HC ID | LC ID |
|---|---|---|
| C33B906 | C33H254 | C33L120 |
| C33B907 | C33H255 | C33L121 |
| C33B908 | C33H256 | C33L122 |
| C33B909 | C33H249 | C33L115 |
| C33B910 | C33H250 | C33L116 |
| C33B911 | C33H251 | C33L117 |
| C33B912 | C33H252 | C33L118 |
| C33B913 | C33H253 | C33L119 |
| C33B914 | C33H254 | C33L120 |
| C33B915 | C33H255 | C33L121 |
| C33B916 | C33H256 | C33L122 |

HC: Heavy Chain;
LC: Light Chain 5-4 Expi293 Small Scale Transfection and Purification Antibodies identified in the immunization campaigns and subsequent v region cloning (into IgG1 F405L and IgG4 PAA) were expressed and purified via small 2 ml scale. Expi293™ cells (ThermoFisher Scientific) were seeded at $1.25 \times 10^5$-$2.25 \times 10^5$ viable cells/mL density in Expi293™ Expression Medium and cultured in polycarbonate, disposable, sterile, vented, non-baffled Erlenmeyer shake flasks in a 37° C., 7% $CO_2$ shaker incubator (INFORS HT Multitron Pro). For routine cell growth in 125 mL-2 L shake flasks, the shake speed was set to 130 rpm for shakers with a 19 mm shaking diameter. Cells were sub-cultured when density reached log phase growth at $3 \times 10^6$-$5 \times 10^6$ viable cells/mL with a 98-99% viability.

On day of transfection, the viable cell density and percent viability was determined. Cells were transfected at a density of $3 \times 10^6$ viable cells/mL. For optimal transfection, sterile Heavy and Light Chain plasmid DNA at 0.1 mg/mL concentration in TE buffer (10 mM Tris-HC1, 1 mM EDTA, pH 8.0) is used.

Expi293™ cells were transfected following manufacturer's Transfection protocol (ThermoFisher Publication Number MAN0007814). Transfection was performed in 24-well deepwell plates (GE Healthcare). Briefly, plasmid DNA was diluted with 0.1 mL OptiMEM™ medium (ThermoFisher Scientific) at the following ratio: 0.250 μg Heavy Chain DNA: 0.750 μg Light Chain DNA: 0.5 μg pAdvantage. 5 μL of ExpiFectamine™ 293 Transfection Reagent was diluted and mixed gently with 95 μL OptiMEM™ medium and incubated for 1 min. The diluted ExpiFectamine™ 293 Reagent was added to the diluted DNA, mixed gently and the ExpiFectamine™ 293/plasmid DNA complexes were incubated at room temperature for 40 minutes. Post-incubation, 1.8 mL Expi293™ cells were added to the complexes incubated overnight in a 37° C., 7% $CO_2$ shaker incubator.

On Day 1 post-transfection, 10 μL ExpiFectamine™ 293 Enhancer land 100 μL Expifectamine 293™ Enhancer 2 were added and the plates were returned to the incubator for an additional 5 days. The culture was harvested on day 6 post-transfection by centrifugation at 850×G for 15 minutes before purification.

1.7 mls of clarified expression supernatants prepared above were transferred to a new 96 2 ml deepwell plate. Purification plates were prepared by pipetting 800 μl of a 1:4 mix of MabSelect SuRe (GE Healthcare) and DPBS-/- slurry into every well of a 96 well Acroprep Advance 1 μm glass filter plate (Pall). 200 mbar of vacuum pressure was applied to the plate to remove excess PBS and subsequently washed with 800 μl fresh PBS. 200 mbar vacuum pressure was applied to remove the wash buffer. The clarified supernatants were then transferred to the PBS washed resin, mixed gently and incubated for 15 minutes. Following the incubation, 200 mbar vacuum pressure was applied to remove the supernatant. The MabSelect SuRe was washed three times with PBS and once with 25 mM Sodium Acetate, pH 5 (TEKNOVA; Hollister, Calif.) with 200 mbar vacuum pressure applied between washes to remove excess buffer. mAbs bound to the resin were eluted using 0.1 M Sodium Acetate, pH 3.5 and incubated for 10 minutes for effective dissociation. The filter plate was placed atop a 96 deepwell plate and the eluted mAbs were collected in the bottom plate via centrifugation at 1000 g for 2 minutes. 80 μl of 2.5 M Tris-Acetate, pH 7.2 was added to neutralize the mAbs. The mAbs were dialyzed into PBS overnight in a 96 well DispoDIALYZER plate (Harvard Apparatus; Holliston, Mass.), transferred to a 96 well Acroprep Advance 0.2 ☐m Supor filter plate (Pall; Port Washington, N.Y.), placed atop a 96 deepwell plate and the protein solutions filtered via centrifugation at 1,500 g for 15 minutes in a desktop centrifuge. Protein concentrations were determined by A280 measurement on the filtrate using a DropSense Instrument (Trinean).

TABLE 43

CD33 mAb Heavy Chain and Light Chain Variable Regions

| HC ID | SEQ ID NO | AMINO ACID SEQUENCE |
|---|---|---|
| B23H1 | 246 | QITLKESGPTLVKPTQTLTLTCTFSGFSLSTSGMGVSWIRQPPGKALEWLAHIYWDDDKRYNPS LKSRLTITKDTSKNQVVLTMTNMDPVDTATYYCARLYGFTYGFAYWGQGTLVTVSS |
| CD3H141 | 247 | EVQLVESGGGLVQPGGSLRLSCAASGFTFNTYAMNWVRQAPGKGLEWVARIRSKYNNYATY YAASVKGRFTISRDDSKNSLYLQMNSLKTEDTAVYYCARHGNFGNSYVSWFAYWGQGTLVT VSS |
| CD3H219 | 20 | QVQLQQSGPRLVRPSQTLSLTCAISGDSVFNNNAAWSWIRQSPSRGLEWLGRTYYRSKWLYD YAVSVKSRITVNPDTSRNQFTLQLNSVTPEDTALYYCARGYSSSFDYWGQGTLVTVSS |
| C33H42 | 248 | QLQLQESGPGLVNPSETLSHTCTVSGGSISSSSHYWGWIRQPPGKGLEWIGKIYYSGNTYYNPS LKSRVTISIDTSKNQFSLKMSSVTAADTAVYYCARLADVVVVPAARYFDSWGQGTLVTVSS |
| C33H44 | 249 | QVQLQQSGPGLVKPSQTLSLTCAISGDSVSSNSAAWNWIRQSPSRGLEWLGRTYYRSKWYND YAVSVRSRITINPDTSKNQFSLQLNSVTPEDTAVYHCARETMFRGLMDYWGQGTLVTVSS |

TABLE 43-continued

CD33 mAb Heavy Chain and Light Chain Variable Regions

| | SEQ ID NO | AMINO ACID SEQUENCE |
|---|---|---|
| C33H45 | 250 | QVQLVESGGGVVQPGRSLRLSCAASGFTFSSYGMHWVRQSPGKGLEWVAVISYDGSNKYCADSVKGRFTISRDNSKSTLYLQMNSLRAEDTAVYYCAKDFRSLDWLPPDSTSYDGMDVWGQGTTVTVSS |
| C33H46 | 251 | QVQLVQSGSELKKPGASVKVSCKASGYTFTNYAMNWVRQAPGQGLEWMGWINTNTGNPTYAQAFTGRFVFSLDTSVSTAYLQISSLKAEDTAVYYCARDREVRDYWGQGTLVTVSS |
| C33H48 | 252 | QLQLQESGPGLVKPSETLSLTCTVSGGSIRSTNYYWGWIRQPPGKGLEWIGTIYYSGNTYYNPSLKSRVTISVDTSKNQFSLKLSSVTAADTAVYYCARLADVVVVPAARYFDYWGQGILVTVSS |
| C33H49 | 253 | QLQLQESGPGLVKPSETLSLTCTVSGGSIRSSGFYWGWIRQPPRKGLEWIGTIYYSGNTYYNPSLKSRVTISVDTSKNQFSLKLSSVTAADTAVYFCARLADVVVVPAARYFDNWGQGTLVTVSS |
| C33H51 | 254 | QLQLQESGPGLVKPSETLSLTCTVSGGSISTGRYYWGWIRQPPGKGVIWIGNIYYSGNTYYNPSLKSRVTISVDTSKNQFSLKLNSVTAADTAVYYCARLGSLVVVPAAMSFDYWGQGTLVTVSS |
| C33H52 | 255 | QLQLQESGPGLVKPSETLSLTCTVSGGSIRGSSYYWGWVRQPPGKGLEWIGSIYSSGNTYYNPSLKSRVTISVDTSKNQFSLKLSSVTAADTALYYCARLGSLVVVPAAMSFDYWGQGTLVTVSS |
| C33H55 | 256 | QVQLQESGPGLVKPSGTLSLTCAVSGGSISSSNWWSWVRQPPGRGLEWIGEIYHSGNTNNSPSLKSRVTISADKSKNQFSLKLSSVTAADTAVYFCARIIAVARYFDSWGQGTLVTVSS |
| C33H65 | 257 | QVQLVESGGGVVQPGRSLRLSCAASGFTFSSYGMHWVRQAPGKGLEWVVVISYDGSNKYYADSVKGRFTISRDNSKNTLYLQMNSLRAEDTAVYYCAKDFRDFDWLPPDSTSYHGMDVWGQGTTVTVSS |
| C33H66 | 258 | QVQLVESGGGVVQPGRSLRLSCVASGFTFSSYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSS |
| C33H68 | 259 | EVQLLESGGGLVQPGGSLGLSCAASGFTFSGYAMSWVRQAPGKGLNWVSAIDYSGNDTYYADSVKGRFTISRDNSKNTLYLQMNSLRAEDTAVYYCAKESQLLHGLFEHWGQGILVTVSS |
| C33H69 | 26 | QLQLQESGPGLVKPSETLSLTCTVSGGSISSSSYYWGWIRQPPGKGLDWIGSINYSGSTYYNPSLKSRVTISVDTSKIQFSLKLRSVTAADTAVYYCARLDGYESPFDYWGQGTLVTVSS |
| C33H70 | 261 | QLQLQESGPGLVKPSETLSLTCTVSGGSIRGSSYYWGWIRQPPGKGLEWIGSIYSSGNTYYNPSLKSRVTISVDTSKNQFSLKLSSVTAADTAVYYCARLGSLVVVPAAMSFDYWGQGTLVTVSS |
| C33H72 | 262 | EVQLVESGGGLVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSS |
| C33H73 | 263 | EVQLLESGGGLVQPGGSLRLSCAASRFTFSSYAMTWVRQAPGKGLEWVSTINISGGSTYYADSVKGRFTISRDNSKNTLYLQMNSLRAEDTAVYYCTKGGYSSGPFDYWGQGTLVSVSS |
| C33H74 | 264 | QVQLVESGGGVVQPGRSLRLSCAASRFTFSSYGMHWVRQAPGKGLEWVAVISYDGSNKYYADSVKGRFTISRDNSKNTLYLQMNSLRAEDTAVHYCAKDFRSFDWLPPDSASYHGMDVWGQGTTVTVSS |
| C33H76 | 265 | EVQLLESGGGLVQPGGSLRLSCAASGFTFNYAMSWVRQAPGKGLEWVSAISGSGGSTYYADSVKGRFTISRDISKNTLYLQMNSLRAEDTAVYYCARTYNSGYYDGDFDYWGQGTLVTVSS |
| C33H78 | 266 | QVQLVESGGGVVQPGRSLRLSCAASGFTFSSYGMHWVRQAPGKGLEWVAVISYDGSNKYYADSVKGRFTISRDNSKNTLFLQMNSLRAEDTAVYYCAKDFRYFDWLPPDSSSYYGMDVWGQGTTVTVSS |
| C33H80 | 267 | QVQLVQSGSELRKPGASVKVSCKASGYTFTNYAMNWVRQAPGQGLEWMGWINTNTGNPTYAQGFTGRFVFSLDTSVSSAYLQISSLKAEDTAMYYCATDRDRGTDYWGQGTLVTVSS |
| C33H81 | 268 | QVQLVESGGGVVQPGRSLRLSCAASGFTFSAYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSS |
| C33H84 | 269 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDFRSFDWLPPDSTSYYGMDVWGQGTTVTVSS |
| C33H87 | 270 | EVQLVESGGGFVQPGGSLRLSCAASGFTFSSYWMSWVRQAPGKGLEWVANIKQHGSEKYYVDSVKGRFTISRDNVKNSLYLQMNSLRTEDTAVYYCARDRDLGYFDYWGQGTLVTVSS |
| C33H88 | 271 | QVQLVQSGSELKKPGASVKVSCKASGYTLTRSAMNWVRQAPGQGLEWMGWINTNTGNPTYAQGFTGRFVFSLDTSVNTAYLLISSLKTEDTAVYYCASDILPGYHEDYWGQGTLVTVSS |

TABLE 43-continued

CD33 mAb Heavy Chain and Light Chain Variable Regions

| | SEQ ID NO | AMINO ACID SEQUENCE |
|---|---|---|
| C33H90 | 272 | QVQLQQSGPGLVKPSQTLSLTCAISGDSVSSNSAAWNWIRQSPSRGLEWLGRTYYRSKWYND YALSVQSRITINPDTSKNQFSLQLNSVTPEDTAVYYCAREVAVAASFDYWGQGTLVTVSS |
| C33H91 | 273 | QLQLQESGPGLVKPSETLSLTCTVSGGSISSRSHYWGWIRQPPGVGLEWIGSIYYTGSTYYNPSL KSRVTISVDTSKNQFSLKLSSVTAADTAVYYCARLADIVVVPAARYFDYWGQGTLVTVSS |
| C33H92 | 274 | QLQLQESGPGLVKPSETLSLTCTVSGGSIRSSSYYWGWIRQPPGKGPEWIGSIYSSGNTYYNPSL KSRVTISVDTSKNQFSLKLISMTAADTAVFYCARLAATIVVPAARYFDCWGQGTLVTVSS |
| C33H98 | 275 | EVQLVESGGGFVQPGGSLRLSCAASGFTFSSYWMSWVRQAPGKGLEWVANIKQHGSEKYYV DSVKGRFTISRDNAKNSLYLQMNSLRAEDTAVYYCARDRDLGYFDYWGQGTLVTVSS |
| C33H99 | 276 | EVQLVESGGGLVQPGGSLRLSCAASGFTFSSYWMTWVRPAPGKGLEWVANIKRDGGEKYYV DSVKGRFTISRDNAANSLYLQMNSLRVEDTAVYYCARPFYDHFDYWGQGTLVTVSS |
| C33H108 | 277 | QVQLVQSGSELKKPGASVKVSCKASGYTFSTYAMNWVRQAPGQGLEWMGWINTNTGNPTYA QGFTGRFVFSLDTSVSTAYLQISSLKAEDTAVYYCARDRDRGTDYWGQGTLVTVSS |
| C33H249 | 278 | EVQLVESGGGLVQPGRSLRLSCVASGFTFDDYAIHWVRQAPGKGLEWVSGLSWNGGNIGYAD SVKGRFTISRDNAKNSLYLQMNSLKTEDTAFYYCTKDTPYGDYFDYWGQGTLVTVSS |
| C33H250 | 279 | EVQLVESGGGLVQPGRSLRLSCAGSGFTFDDYAIHWVRQAPGKGLEWVSGLSWNGGNIGYAD SVKGRFTISRDNAKNSLYLQLNSLKTEDTAFYYCAKDSPYGDYFDYWGQGTLVTVSS |
| C33H251 | 280 | EVQLVESGGGLVQPGRSLRLSCAASGFTFDDYAMHWVRQAPGKGLEWVSGIGWSGGSIVYAD SVKGRFKISRDNAKNSLYLQMNSLRAEDTALYYCAKDSPYGDFFDYWGQGTLVTVSS |
| C33H252 | 281 | EVQLVESGGGLVQPGRSLRLSCAASGFTFDDYAMHWVRQAPGKGLEWVSGIGWSGGSIVYAD SVKGRFTISRDNAKNSLYLQMNSLRAEDTALYYCAKDSPYGDFFDYWGQGTLVTVSS |
| C33H253 | 282 | EVQLLESGGGLVQPGGSLKLSCTASGFTFRSYAMSWVRQAPGKGLEWVSAINGYGDGRYYAD SVKGRFTISRDNSKNTLYLQMNSLRAEDTAVYSCAKDQGFGELFFDYWGQGTLVTVSS |
| C33H254 | 283 | QVQLVESGGGVVQPGRSLRLSCAASGFTFSYYGMHWVRQAPDKGLEWVAVIWFDGNNKYY ADSVKGRFTISRDNSKNTLYLQMNSLRAEDTAVYYCARDRELLFDYWGQGTLVTVSS |
| C33H255 | 284 | EVQLVESGGGLVQPGRSLRLSCAASGFTFDDYAMHWVRQVPGEGLEWVSGISWNGGDMVYA DSVKGRFTISRDNAKNSLYLQMNSLRPEDTALYYCVKDMPYFDFLTGSDYYYYGMDVWGQG TTVTVSS |
| C33H256 | 285 | QVQLVESGGGVVQPGRSLRLSCATSGFTFSNYGMHWVRQAPGKGLEWVAVIWYVGSHKYYA DSVKGRFTISRDNSKNTLYLQMNSLRAEDTAVYYCARDGSLCFDYWGQGTLVTVSS |
| LC ID | | |
| B23L3 | 286 | DIVMTQSPDSLAVSLGERATINCRASQSVDYNGISYMHWYQQKPGQPPKLLIYAASNPESGVP DRFSGSGSGTDFTLTISSLQAEDVAVYYCQQIIEDPWTFGQGTKVEIK |
| CD3L66 | 287 | QTVVTQEPSLTVSPGGTVTLTCRSSTGAVTTSNYANWVQQKPGQAPRGLIGGTNKRAPGTPAR FSGSLLGGKAALTLSGVQPEDEAEYYCALWYSNLWVFGGGTKLTVL |
| CD3L150 | 52 | QSALTQPASVSGSPGQSITISCTGTSSNIGTYKFVSWYQQHPDKAPKVLLYEVSKRPSGVSSRFS GSKSGNTASLTISGLQAEDQADYHCVSYAGSGTLLFGGGTKLTVL |
| C33L8 | 288 | SYELTQPPSVSVSPGQTASIICSGDKLGNKYACWYQQKPGQSPVLVIYQDSKRPSGIPERFSGSN SGNTATLTISGTQAVDEADYYCQAWDSSTYVFGTGTKVTVL |
| C33L10 | 289 | SYVLTQPPSVSVAPGQTARITCGGSNIGSKSVHWYQQKPGQAPVMVVYDDSDRPSGIPERFSGS NSGNTATLTISRVEAGDEADYYCQVWDSSSDVVFGGGTKLTVL |
| C33L11 | 290 | SYELTQPPSVSVSPGQTASITCSGHKLGDKYACWYQQKPGQSPVVVIYKDSKRPSGIPERFSGS NFGNTATLTISGTQAMDEADYYCQAWDSSTVVFGGGTKLTVL |
| IAPL24 | 291 | SYELTQPPSVSVSPGQTASITCSGDKLGDKYACWYQQKPGQSPVLVIYQDSKRPSGIPERFSGSN SGNTATLTISGTQAMDEADYYCQAWDSSTVVFGGGTKLTVL |
| C33L58 | 292 | SYELTQPPSVSVSPGQTASITCSGDKLGDKYACWYQQKPGQSPVLVIYQDYKRPSGIPERFSGS NSGNTATLTISGTQAMDEADYYCQAWDSSTYVFGTGTKVTVL |
| C33L59 | 293 | SYELTQPPSVSVSPGQTASITCSGDKLGDKYACWYQQKPGQSPVLVIYQDYKRPSGIPERFSGS NSGNTATLTISGTQTMDEADYYCQAWDISTYVFGTGTKVTVL |
| C33L34 | 294 | SYELTQPPSVSVSPGQTASITCSGDKLGDKYACWYQLRPGQSPILVIYQDSNRPSGIPERFSGSNS GNTATLTISGTQAMDEADYYCQAWDSSTWVFGGGTKLTVL |

TABLE 43-continued

CD33 mAb Heavy Chain and Light Chain Variable Regions

| | SEQ ID NO | AMINO ACID SEQUENCE |
|---|---|---|
| N46L109 | 295 | SYELTQPPSVSVSPGQTASITCSGDKLGDKYACWYQQKPGQSPVLVIYQDSKRPSGIPERFSGSNSGNTATLTISGTQAMDEADYYCQAWDSSTWVFGGGTKLTVL |
| C33L42 | 296 | SYVLTQPPSVSVAPGQTARITCGGNNIGEKSVHWYQQKPGQAPVLVVYDDSDRPPGIPERFSGSNSGNTATLTITRVEAGDEADYYCQVWDSSSDHVVFGGGTKLTVL |
| C33L47 | 297 | SYELTQPPSVSVSPGQTASITCSGDKLGDKYACWYQQKPGQSPVVVIYQDRKRPSGIPERFSGSNFGNTATLTISGTQAMDEADYYCQAWDSSTVVFGGGTKLTVL |
| C33L60 | 298 | SYELTQPPSVSVSPGQTASITCSGDKLGDKYACWYQQKPGQSPVLVIYQDGKRPSGIPERFSGSNFGNKATLTISGTQAMDEADYYCQAWDRNTVVFGGGTKLTVL |
| C33L17 | 299 | DIVMTQSPDSLAVSLGERATINCKSSQSVLYSSNNKNYLAWYQQKAGQPPKLLIYWASTRESGVPDRFSGSGSGTDFILIISSLQAEDVAVYYCQQYYGTPWTFGQGTKVEIK |
| C4LL152 | 300 | DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK |
| C33L40 | 301 | SYELTQPPSVSVSPGQTASITCSGNKLGAKFASWYQQKPGQSPVLVIYQDNKRPSGIPERFSGSNSGNTATLTISGTQAVDEADYYCQAWDSSTVVFGGGTKLTVL |
| C33L32 | 302 | SYELTQPPSVSVSPGQTASITCSGDKLGDKYVRWYQQKTGQSPVLVMYQDSKRPSGIRERFYGSNSGNTATPTISGTQAVDEAEYYCQAWDSSTGVVFGGGTKLTVL |
| C33L38 | 303 | SYELTQPPSVSVPPGQTASITCSGDKLGDKYACWYQQKPGQSPVLVIYQDNKRPSGIPERFSGSNSGNTATLTISGTQAMDEADYYCQAWGRNTVVFGGGTKLTVL |
| C33L39 | 304 | QSALTQPASVSGSPGQSIPISSTGTSSDDGKNNIVSWYQQHPGKAPKLMIYKDSKRPSGVSNRFSGSKSGNTASLTISGLQADDEADYHCCSYAGASNHVVFGGGTKLTVL |
| C33L57 | 305 | SYELTQPPSVSVSPGQTASITCSGDELGNKYACWYQQKPGQSPVVVVYQDRKRPSGIPERFSGSNFGNTATLTISGTQAMDEADYYCQAWDSSTVVFGGGTKLTVL |
| C33L73 | 306 | QSALTQPASVSGSPGQSITISCTGTSSDVGDYNYVSWYQQHPGKVPKLMIYDVSNRPSGVSNRFSGSMSGNTASLTISGLQAEDEADYYCSSYSSSSALEVFGGGTKLTVL |
| C33L53 | 307 | SYELTQPPSVSVSPGQTASITCSGDKLGDKYACWYQQKPGQSPVLVIYQDNKRPSGIPERFSGSNSGNTATLTISGTQAMDEADYYCQAWDSNTVVFGGGTKLTVL |
| C33L66 | 308 | SYELTQPPSVSVSPGQTASITCSGDKLGDKYVCWYQQKPGQSPVVVIHQDRKRPSGIPERFSGSNFGNTATLTISGTQAMDEADYYCQAWDSSTVVFGGGTKLTVL |
| C33L35 | 309 | SYELTQPPSVSVSPGQTASITCSGDKLGNKYASWYQQKPGQSPVLVIYQDTKRPSGIPERVSGSNSGNTATLTISGTQAMDEADYHCQAWDSSTVVFGGGTKLTVL |
| C33L61 | 310 | QSALTQPASVSGSPGQSITISCTGINSDVGSYDLVSWYQQHPGKAPKLLIYDGSERPSGVFGRFSGSKSDNTTSLTISGLQAEDEAAYYCCSYEVTTTYVVFGGGTKLTVL |
| C33L51 | 311 | SYVLTQPPSVSVAPGQTARITCGGNNIGSKSVHWSQQKPGQAPVLVVYDDSDRPSGIPERFSGSNSGNTATLTISRVEAGDEADYYCQVWDSNSDHVVFGGGTKLTVL |
| C33L44 | 312 | SYELTQPPSVSVSPGQTASITCSGDKLGDKYACWYQQKPGQSPVLVIYQDSNRPSGIPERFSGSNSGNTATLTISETQAMDEADYYCQAWDSSTYVFGTGTKVTVL |
| C33L30 | 313 | SYELTQPPSVSVSPGQTVSISCSGDRLGDKYACWYQQKPGQSPVLVIYQDSKRPSGIPERFSGSNSGNTATLTISGTQAMDEADYYCQAWDSSSYVFGTGTKVTVL |
| C33L69 | 314 | SYELTQPPSVSVSPGQTASITCSGDKLGSKFACWYQQKPGQSPVLVIYQDSKRPSGIPERFSGSNSGNTATLTISGTQAMDEADYYCQAWDSSTVVFGGGTKLTVL |
| C33L37 | 315 | SYVLTQPPSVAVAPGQTARITCGGSNIGKISVHWYQQKAGQAPVLVVHDDRARPSGIPERLSGSNSGTTATLTISRVEVGDEADYYCQVWNSSSVHPVFGGGTKLTVL |
| C33L74 | 316 | QSALTQPASVSGSPGQSITISCTGTSSDVGDDNYVSWYQQHPGKAPKLMIYDVSNRPSGVSNRFSGSKSGNTASLTISGLQSEDEADYYCSSYSSSTTLEVFGGGTKLTVL |
| C33L115 | 317 | DIQMTQSPSSVWASVGDRVTITCRASQGISSWLAWYQQQPGKAPNLLIYRSSSLQSGVPSRFSGSGSGTDFTLTISSLQPEDFATYYCQQDNSFPYTFGQGTKLEIK |
| C33L116 | 318 | DIQMTQSPSSEWASVGDRVTITCRASQGISSWLAWYQQKPGKAPKLLIYGASSWQSGVPSRFSGSGSGTDFTLTISSLQPEDFATYYCQQDNSFPYTFGQGTKLEIK |

TABLE 43-continued

CD33 mAb Heavy Chain and Light Chain Variable Regions

| | SEQ ID NO | AMINO ACID SEQUENCE |
|---|---|---|
| C33L117 | 319 | DIVMTQSPDSLAVSLGERATINCKSSQTVLYSSNNKNYLAWYQQKPGQPPKLLISWASTRKSG VPDRFSGSGSGTDFTLTVSSLQAEDVAVYYCQHYYSTPYTFGQGTKLEIK |
| C33L118 | 320 | DIVMTQSPDSLAVSLGERATINCKSSQTVFYSSNNKNYLAWYQQKPGQPPKLLISWASTRKSG VPDRFSGSGSGTDFTLTVSSLQAEDVAVYYCQHYYSTPYTFGQGTKLEIK |
| C33L119 | 321 | DIQMTQSPSTLSASVGDRVTITCRASQSISSWLAWYQQKPGKAPKLLIYKASSLESGVPSRFSGS GSGTEFTLTISSLQPDDFATYCCQQYNSYPWTFGQGTKVEEK |
| C33L120 | 322 | SYELTQPPSVSVSPGQTASITCSGDELGDMYACWYQQKPGQSPLVVIYQDSKRPSGIPERFSGSN SGNTATLTISGTQAMDEAAYYCQTWDTRIAVFGGGTNLTVL |
| C33L121 | 323 | SYELTQPPSVSVSPGQTASITCSGDNLGNEHVCWYHQKPGQSPVLVIYQNNKRPSGIPERFSGSN SGNTATLSISGTQATDEADYYCQAWDSTTAVFGGGTKLTVL |
| C33L122 | 324 | SYELTQPPSVSVSPGQTANISCSGVTLGYNYAYWYQQKPGQSPILVISQDTQRPSGIPERFSGSN SGNTATLTISGTQAMDEAAYYCQAWDITTVLFGGGTKLTVL |
| C33L132 | 325 | SYELTQPPSVSVSPGQTASITCSGDKLGDKYASWYQQKPGQSPVLVIYQDGKRPSGIPERFSGSN FGNKATLTISGTQAMDEADYYCQAWDRNTVVFGGGTKLTVL |
| C33L41 | 326 | SYELTQPPSVSVSPGQTASITCSGDKLGNKYASWYQQKPGQSPVLVIYQDSKRPSGIPERFSGSN SGNTATLTISGTQAMDEADYYCQAWDSSTVVFGGGTKLTVL |

TABLE 44

CD33 mAb Heavy Chain CDR1-3 sequences

| HC ID | CDR1 | ID | CDR2 | ID | CDR3 | ID |
|---|---|---|---|---|---|---|
| B23H1 | GFSLSTSGMG | 327 | IYWDDDK | 368 | ARLYGFTYGFAY | 409 |
| CD3H141 | GFTFNTYA | 328 | IRSKYNNYAT | 369 | ARHGNFGNSYVSWFAY | 410 |
| CD3H219 | GDSVFNNNAAY | 329 | TYYRSKWL | 370 | ARGYSSSFDY | 411 |
| C33H42 | GGSISSSSHY | 330 | IYYSGNT | 371 | ARLADVVVVPAARYFDS | 412 |
| C33H44 | GDSVSSNSAAN | 331 | TYYRSKWY | 372 | ARETMFRGLMDY | 413 |
| C33H45 | GFTFSSYG | 332 | ISYDGSNK | 373 | AKDFRSLDWLPPDSTSYDGMDV | 414 |
| C33H46 | GYTFTNYA | 333 | INTNTGNP | 374 | ARDREVRDY | 415 |
| C33H48 | GGSIRSTNYY | 334 | IYYSGNT | 375 | ARLADVVVVPAARYFDY | 416 |
| C33H49 | GGSIRSSGFY | 335 | IYYSGNT | 376 | ARLADVVVVPAARYFDN | 417 |
| C33H51 | GGSISTGRYY | 336 | IYYSGNT | 377 | ARLGSLVVVPAAMSFDY | 418 |
| C33H52 | GGSIRGSSYY | 337 | IYSSGNT | 378 | ARLGSLVVVPAAMSFDY | 419 |
| C33H55 | GGSISSSNW | 338 | IYHSGNT | 379 | ARIIAVARYFDS | 420 |
| C33H65 | GFTFSSYG | 339 | ISYDGSNK | 380 | AKDFRDFDWLPPDSTSYHGMDV | 421 |
| C33H66 | GFTFSSYG | 340 | ISYDGSNK | 381 | AKDFRSFDWLPPDSASYHGMDV | 422 |
| C33H68 | GFTFSGYA | 341 | IDYSGNDT | 382 | AKESQLLHGLFEH | 423 |
| C33H69 | GGSISSSSYY | 342 | INYSGST | 383 | ARLDGYESPFDY | 424 |
| C33H70 | GGSIRGSSYY | 343 | IYSSGNT | 384 | ARLGSLVVVPAAMSFDY | 425 |
| C33H72 | GFTFSSYW | 344 | IKQHGSEK | 385 | ARDRDLGYFDY | 426 |
| C33H73 | RFTFSSYA | 345 | INISGGST | 386 | TKGGYSSGPFDY | 427 |
| C33H74 | RFTFSSYG | 346 | ISYDGSNK | 387 | AKDFRSFDWLPPDSASYHGMDV | 428 |
| C33H76 | GFTFNYA | 347 | ISGSGGST | 388 | ARTYNSGYYDGDFDY | 429 |
| C33H78 | GFTFSSYG | 348 | ISYDGSNK | 389 | AKDFRYFDWLPPDSSSYYGMDV | 430 |
| C33H80 | GYTFTNYA | 349 | INTNTGNP | 390 | ATDRDRGTDY | 431 |
| C33H81 | GFTFSAYG | 350 | ISYDGSNK | 391 | AKDFRSFDWLPPDSASYHGMDV | 432 |
| C33H84 | GFTFSSYG | 351 | ISYDGSNK | 392 | AKDFRSFDWLPPDSTSYYGMDV | 433 |
| C33H87 | GFTFSSYW | 352 | IKQHGSEK | 393 | ARDRDLGYFDY | 434 |
| C33H88 | GYTLTRSA | 353 | INTNTGNP | 394 | ASDILPGYHEDY | 435 |
| C33H90 | GDSVSSNSAAN | 354 | TYYRSKWY | 395 | AREVAVAASFDY | 436 |
| C33H91 | GGSISSRSHY | 355 | IYYTGST | 396 | ARLADIVVVPAARYFDY | 437 |
| C33H92 | GGSIRSSSYY | 356 | IYSSGNT | 397 | ARLAATIVVPAARYFDC | 438 |

TABLE 44-continued

CD33 mAb Heavy Chain CDR1-3 sequences

| HC ID | CDR1 | ID | CDR2 | ID | CDR3 | ID |
|---|---|---|---|---|---|---|
| C33H98 | GFTFSSYW | 357 | IKQHGSEK | 398 | ARDRDLGYFDY | 439 |
| C33H99 | GFTFSSYW | 358 | IKRDGGEK | 399 | ARPFYDHFDY | 440 |
| C33H108 | GYTFSTYA | 359 | INTNTGNP | 400 | ARDRDRGTDY | 441 |
| C33H249 | GFTFDDYA | 360 | LSWNGGNI | 401 | TKDTPYGDYFDY | 442 |
| C33H250 | GFTFDDYA | 361 | LSWNGGNI | 402 | AKDSPYGDYFDY | 443 |
| C33H251 | GFTFDDYA | 362 | IGWSGGSI | 403 | AKDSPYGDFFDY | 444 |
| C33H252 | GFTFDDYA | 363 | IGWSGGSI | 404 | AKDSPYGDFFDY | 445 |
| C33H253 | GFTFRSYA | 364 | INGYGDGR | 405 | AKDQGFGELFFDY | 446 |
| C33H254 | GFTFSYYG | 365 | IWFDGNNK | 406 | ARDRELLFDY | 447 |
| C33H255 | GFTFDDYA | 366 | ISWNGGDM | 407 | VKDMPYFDFLTGSDYYYGMDV | 448 |
| C33H256 | GFTFSNYG | 367 | IWYVGSHK | 408 | ARDGSLCFDY | 449 |

TABLE 45

CD3 mAb Light Chain CDR1-3 sequences

| LC ID | CDR1 | ID | CDR2 | ID | CDR3 | ID |
|---|---|---|---|---|---|---|
| B23L3 | QSVDYNGISY | 450 | AAS | 492 | QQIIEDPWT | 534 |
| CD3L66 | TGAVTTSNY | 451 | GTN | 493 | ALWYSNLWV | 535 |
| CD3L150 | SSNIGTYKF | 452 | EVS | 494 | VSYAGSGTLL | 536 |
| C33L8 | KLGNKY | 453 | QDS | 495 | QAWDSSTYV | 537 |
| C33L10 | NIGSKS | 454 | DDS | 496 | QVWDSSSDVV | 538 |
| C33L11 | KLGDKY | 455 | KDS | 497 | QAWDSSTVV | 539 |
| IAPL24 | KLGDKY | 456 | QDS | 498 | QAWDSSTVV | 540 |
| C33L58 | KLGDKY | 457 | QDY | 499 | QAWDSSTYV | 541 |
| C33L59 | KLGDKY | 458 | QDY | 500 | QAWDISTYV | 542 |
| C33L34 | KLGDKY | 459 | QDS | 501 | QAWDSSTWV | 543 |
| N46L109 | KLGDKY | 460 | QDS | 502 | QAWDSSTWV | 544 |
| C33L42 | NIGIKS | 461 | DDS | 503 | QVWDSSSDHVV | 545 |
| C33L47 | KLGDKY | 462 | QDR | 504 | QAWDSSTVV | 546 |
| C33L60 | KLGDKY | 463 | QDG | 505 | QAWDRNTVV | 547 |
| C33L17 | QSVLYSSNNKY | 464 | WAS | 506 | QQYYGTPWT | 548 |
| C4LL152 | QGISSW | 465 | AAS | 507 | QQANSFPFT | 549 |
| C33L40 | KLGAKF | 466 | QDN | 508 | QAWDSSTVV | 550 |
| C33L32 | KLGDKY | 467 | QDS | 509 | QAWDSSTGVV | 551 |
| C33L38 | KLGDKY | 468 | QDN | 510 | QAWGRNTVV | 552 |
| C33L39 | SSDDGKNNI | 469 | KDS | 511 | CSYAGASNHVV | 553 |
| C33L57 | ELGNKY | 470 | QDR | 512 | QAWDSSTVV | 554 |
| C33L73 | SSDVGDYNY | 471 | DVS | 513 | SSYSSSSALEV | 555 |
| C33L53 | KLGDKY | 472 | QDN | 514 | QAWDSNTVV | 556 |
| C33L66 | KLGDKY | 473 | QDR | 515 | QAWDSSTVV | 557 |
| C33L35 | KLGNKY | 474 | QDT | 516 | QAWDSSTVV | 558 |
| C33L61 | NSDVGSYDL | 475 | DGS | 517 | CSYEVTTTYVV | 559 |
| C33L51 | NIGSKS | 476 | DDS | 518 | QVWDSNSDHVV | 560 |
| C33L44 | KLGDKY | 477 | QDS | 519 | QAWDSSTYV | 561 |
| C33L30 | RLGDKY | 478 | QDS | 520 | QAWDSSSYV | 562 |
| C33L69 | KLGSKF | 479 | QDS | 521 | QAWDSSTVV | 563 |
| C33L37 | NIGKIS | 480 | DDR | 522 | QVWNSSSVHPV | 564 |
| C33L74 | SSDVGDDNY | 481 | DVS | 523 | SSYSSSTTLEV | 565 |
| C33L115 | QGISSW | 482 | RSS | 524 | QQDNSFPYT | 566 |
| C33L116 | QGISSW | 483 | GAS | 525 | QQDNSFPYT | 567 |
| C33L117 | QTVLYSSNNKNY | 484 | WAS | 526 | QHYYSTPYT | 568 |
| C33L118 | QTVFYSSNNKNY | 485 | WAS | 527 | QHYYSTPYT | 569 |
| C33L119 | QSISSW | 486 | KAS | 528 | QQYNSYPWT | 570 |
| C33L120 | ELGDMY | 487 | QDS | 529 | QTWDTRIAV | 571 |
| C33L121 | NLGNEH | 488 | QNN | 530 | QAWDSTTAV | 572 |
| C33L122 | TLGYNY | 489 | QDT | 531 | QAWDITTVL | 573 |
| C33L132 | KLGDKY | 490 | QDG | 532 | QAWDRNTVV | 574 |
| C33L41 | KLGNKY | 491 | QDS | 533 | QAWDSSTVV | 634 |

5-5 Characterization of Anti-CD33 mAbs

OMNIRat antibodies identified via immunization, v-region cloned and subsequently expressed and purified were characterized further for binding to CD33 expressing cells and binding to recombinant antigens. The purified antibodies were assessed for binding to stably transfected HTEK293F cells expressing human CD33 or cyno CD33 (generation described above) along with the parental HTEK293F as negative control. Cells were harvested from tissue culture flasks using non-enzymatic dissociation buffer (Thermo Scientific). The flasks were rinsed twice with PBS and dissociation buffer was added to the flask, and the flask was incubated for 10 minutes at 37° C. until the cells became non-adherent. The cells were centrifuged at 300 g for 5 minutes and resuspended at $1.0 \times 10^6$ cells/ml in staining buffer (Becton Dickinson; Franklin Lakes, N.J.). 50,000 cells/well of each cell type was plated in 50 μl of staining buffer in round bottom plates (Becton Dickinson). 50 μl of 2× concentration test mAb or isotype control was added at 3 dilutions and zero (120 nM, 12 nM, and 1.2 nM and 0 nM), and the resultant solution was incubated 30 min at 4° C. 100 μl staining buffer was added to all wells of each plate, the plates were spun at 300 g for 5 min, the buffer was removed, 200 μl staining buffer was added to all wells of each plate, the plates were spun at 300 g for 5 min, and the buffer was removed. 50 μl of 2 μg/ml of Goat-anti-human Fc AF647 secondary antibody (Jackson Immunoresearch; West Grove, Pa.) was added to all wells of the plates, and the plates were incubated for 30 min at 4° C. 100 μl staining buffer was added to all wells of the plates, the plates were spun at 300 g for 5 min, and the buffer was removed. 200 μl running buffer (running buffer is Staining buffer, 1 mM EDTA, 0.1% Pluronic Acid) was added to all wells of the plates, the plates were spun at 300 g for 5 min, and the buffer was removed. 30 μl running buffer containing Sytox Green live/dead dye (ThermoFisher) was added to all wells with cells and the plates were read on an iQue IntelliCyt flow cytometer. Cells were gated on forward vs. side scatter to eliminate debris, then on singlets and then on live cells which excluded the Sytox stain. Antibody binding was assessed by the mean fluorescence intensity in the AF647 channel.

To begin assessing the biophysical binding properties of the purified mAbs an off-rate screen was performed. 76 OMNIRat anti-CD33 mAbs were tested for binding to recombinant human CD33 ECD-HSA (C33W2) and cyno CD33 ECD-HSA (C33W1) proteins (Janssen production) and the off-rate was measured by IBIS MX96 SPRi array platform (Carterra; Newton, Pa.). Goat anti-human Fc IgG (Jackson Immunoresearch, Cat #109-005-098) was directly immobilized via amine coupling at 100 μg/mL in acetate buffer, pH 4.5 using a CMD50m sensor chip (Xantec, lot CMD50m0415.a) with an association time of 10 minutes in the IBIS instrument. An average GAH-Fc immobilization level of ~9000 Rus was achieved. The sensor chip was transferred to the Continuous Flow Microspotter (CFM) unit to capture each anti-CD33 mAb at 10 μg/ml for 10 minutes. Binding was measured on IBIS SPRi by single cycle kinetics without regeneration. Each antigen concentration series (3 μM in 3 fold dilution series) was sequentially injected from low (0.46 nM) to high concentrations (3 μM) to bind to captured mAbs with an association time of 5 minutes and dissociation time of 15 minutes using PBST (PBS with 0.005% Tween) as running buffer. The raw binding data (.trix file format) were referenced and aligned using SprintX software (Wasatch, Ver 1.9.3.2), then exported (.ibmx file format) to Scrubber software (Ver. 2.0) for 1:1 binding kinetic analyses (Wasatch, version 2.0.0.33) to extract the $k_{off}$ results.

Table 46 below summarizes the top 32 clones as assessed by binding to human and cyno CD33 expressing cell lines as well as towards recombinant antigen (off-rate of at least >10e-3 for one of the antigens). Of these 32, all but 4 showed appreciable binding to either human or cyno expressing cells. All 32 were carried for further characterization via epitope binning and full kinetic analysis.

TABLE 46

Cell Binding and Off-Rate analysis of the anti-CD33 antibodies derived from OMNIRat

| Prot. AA ID | % Mon | 60 nM CD33 | 6 nM CD33 | 0.6 nM CD33 | 0 nM CD33 | $K_D$ |
|---|---|---|---|---|---|---|
| C33B48 | 91.96 | 400995.84 | 428948.75 | 391157.69 | 91.12 | 5.47E−05 |
| C33B73 | 100.00 | 201493.02 | 33443.28 | 4034.64 | 93.98 | 9.12E−05 |
| C33B125 | 98.48 | 258779.13 | 79728.78 | 9203.75 | 78.26 | 1.54E−04 |
| C33B55 | 96.39 | 188278.42 | 59155.10 | 7625.56 | 105.39 | 2.15E−04 |
| C33B96 | 98.75 | 476040.28 | 475653.41 | 187925.80 | 55.23 | 2.28E−04 |
| C33B124 | 100.00 | 798.33 | 126.37 | 90.26 | 172.03 | 2.38E−04 |
| C33B72 | 96.94 | 328194.72 | 105474.59 | 12506.85 | 93.32 | 2.84E−04 |
| C33B79 | 100.00 | 236644.03 | 41925.89 | 4988.81 | 77.78 | 3.28E−04 |
| C33B77 | 92.11 | 241787.16 | 88691.05 | 11484.97 | 69.46 | 3.37E−04 |
| C33B82 | 96.21 | 188508.56 | 41264.92 | 5033.60 | 73.44 | 3.41E−04 |
| C33B87 | 100.00 | 242185.48 | 79532.87 | 12547.05 | 73.65 | 3.52E−04 |
| C33B80 | 98.33 | 5799.64 | 409.97 | 114.93 | 88.88 | 3.84E−04 |
| C33B101 | 96.91 | 268805.28 | 204984.16 | 35513.63 | 70.07 | 3.98E−04 |
| C33B83 | 98.07 | 92956.55 | 7856.70 | 1020.48 | 87.37 | 4.61E−04 |
| C33B46 | 95.81 | 509865.97 | 447627.97 | 418017.22 | 134.53 | 4.67E−04 |
| C33B94 | 98.31 | 200142.00 | 93852.22 | 13274.87 | 89.59 | 5.38E−04 |
| C33B88 | 98.36 | 393148.13 | 481100.91 | 274293.53 | 94.81 | 8.25E−04 |
| C33B66 | 98.71 | 444680.31 | 313288.41 | 56628.04 | 129.73 | 8.59E−04 |
| C33B120 | 97.63 | 190036.14 | 60357.11 | 7054.28 | 92.94 | 1.40E−03 |
| C33B64 | 98.13 | 200158.36 | 54138.77 | 7556.04 | 114.85 | 1.71E−03 |
| C33B52 | 96.76 | 196557.09 | 46286.13 | 6751.01 | 82.46 | 3.13E−03 |
| C33B56 | 95.59 | 143.73 | 79.73 | 111.95 | 138.04 | 4.02E−03 |
| C33B75 | 98.68 | 163795.25 | 29603.57 | 4517.81 | 95.94 | 4.16E−03 |
| C33B107 | 96.90 | 375388.25 | 339798.53 | 161369.64 | 86.54 | 4.44E−03 |
| C33B63 | 98.79 | 247758.77 | 62221.71 | 9671.48 | 86.34 | 4.57E−03 |
| C33B95 | 97.77 | 154556.58 | 44354.07 | 6402.00 | 87.38 | 5.99E−03 |
| C33B61 | 98.87 | 198777.34 | 38699.10 | 5308.45 | 79.84 | 6.71E−03 |
| C33B89 | 100.00 | 315.38 | 119.12 | 65.61 | 70.94 | 8.11E−03 |
| C33B122 | 98.49 | 259183.69 | 84281.03 | 14291.17 | 65.01 | 8.74E−03 |
| C33B62 | 99.05 | 157786.36 | 37359.44 | 6092.03 | 75.00 | 1.00E−02 |
| C33B123 | 95.08 | 224078.95 | 88155.99 | 8864.39 | 71.05 | 1.03E−02 |
| C33B54 | 100.00 | 147753.30 | 27461.06 | 3766.69 | 61.26 | 2.48E−02 |

| Prot. AA ID | 60 nM Cyno CD33 | 6 nM Cyno CD33 | 0.6 nM Cyno CD33 | 0 nM Cyno CD33 | Cyno CD33 binding $K_D$ |
|---|---|---|---|---|---|
| C33B48 | 56491.32 | 47326.85 | 43351.12 | 94.01 | 1.20E−04 |
| C33B73 | 14799.14 | 6987.92 | 795.57 | 72.51 | 4.08E−04 |
| C33B125 | 15603.45 | 11526.47 | 3458.27 | 70.22 | 3.51E−04 |
| C33B55 | 16020.78 | 9994.42 | 2433.94 | 69.38 | 1.16E−04 |
| C33B96 | 37273.19 | 20087.29 | 11574.59 | 86.31 | 8.19E−04 |
| C33B124 | 593.00 | 132.19 | 77.26 | 98.41 | 4.77E−04 |
| C33B72 | 19422.07 | 13975.14 | 3894.84 | 90.81 | 7.63E−04 |
| C33B79 | 15538.97 | 6427.73 | 1082.85 | 63.59 | 6.82E−03 |
| C33B77 | 17516.20 | 11665.49 | 3601.76 | 85.23 | 4.18E−04 |

TABLE 46-continued

Cell Binding and Off-Rate analysis of the anti-CD33 antibodies derived from OMNIRat

| | | | | | |
|---|---|---|---|---|---|
| C33B82 | 14269.38 | 6622.07 | 1540.09 | 84.24 | 6.70E−04 |
| C33B87 | 19597.18 | 12652.44 | 3266.36 | 103.07 | 2.28E−04 |
| C33B80 | 4612.58 | 248.60 | 108.93 | 82.38 | 2.66E−04 |
| C33B101 | 48016.75 | 46115.96 | 17989.37 | 79.69 | 1.06E−04 |
| C33B83 | 5304.40 | 687.44 | 159.37 | 87.35 | 2.17E−03 |
| C33B46 | 49840.14 | 49816.36 | 49729.78 | 92.05 | 1.48E−04 |
| C33B94 | 16126.84 | 10782.54 | 3183.70 | 87.82 | 5.37E−04 |
| C33B88 | 50388.18 | 43928.95 | 43940.23 | 90.13 | 3.89E−04 |
| C33B66 | 48905.04 | 49076.39 | 42160.22 | 77.96 | 9.33E−05 |
| C33B120 | 13211.32 | 7865.37 | 2726.18 | 75.77 | 8.54E−04 |
| C33B64 | 21109.59 | 9685.04 | 3102.56 | 99.82 | 1.21E−03 |
| C33B52 | 12582.90 | 8444.39 | 2063.44 | 75.24 | 1.20E−03 |
| C33B56 | 104.27 | 85.94 | 78.56 | 83.31 | 8.46E−04 |
| C33B75 | 12194.41 | 5577.80 | 1709.40 | 124.32 | 1.20E−03 |
| C33B107 | 50325.07 | 47810.05 | 36786.69 | 55.11 | 1.35E−04 |
| C33B63 | 18322.71 | 11642.38 | 2879.89 | 87.94 | 9.47E−04 |
| C33B95 | 14774.34 | 9594.12 | 1637.99 | 80.81 | 6.98E−03 |
| C33B61 | 13552.71 | 8211.09 | 1595.90 | 106.84 | 1.83E−03 |
| C33B89 | 47301.14 | 34193.78 | 23334.20 | 112.80 | 4.65E−05 |
| C33B122 | 19740.29 | 13907.32 | 5838.25 | 82.53 | 1.45E−04 |
| C33B62 | 12737.71 | 5620.17 | 1922.97 | 934.44 | 1.32E−03 |
| C33B123 | 10665.93 | 10404.03 | 3232.18 | 61.08 | 2.74E−03 |
| C33B54 | 50466.68 | 43011.75 | 38091.89 | 28785.80 | 1.35E−04 |

Table 46, continued:

The panel of mAbs was then further characterized for full affinity analysis as well as epitope binning. The binding of anti-CD33 mAbs to recombinant human CD33 ECD-HSA (C33W2) and cyno CD33 ECD-HSA (C33W1) was measured by ProteOn SPR (Bio-Rad). Goat anti-human Fc IgG (Jackson Immunoresearch, Cat #109-005-098) was directly immobilized via amine coupling at 30 µg/mL in acetate buffer, pH 5.0 on all 6 ligand channels in vertical orientation on a GLC Sensor Chip (Bio-Rad, catalog no. 176-5011) with a flow rate of 30 µL/min in PBS containing 0.005% Tween-20. The immobilization densities averaged about 5000 Response Units (RU) with less than 5% variation among different channels. Different mAbs were captured on the anti-human Fc IgG surface at 0.25 or 0.5 µg/ml (160-300 RU) in vertical ligand orientation, with the $6^{th}$ ligand channel as no ligand surface control. Human and cyno CD33-HSA proteins at 0.3 µM concentration in 3-fold dilution series of 5 concentrations flew in as analyte to bind to captured mAbs in the horizontal orientation. A buffer sample was also injected in the $6^{th}$ channel to monitor the dissociation of captured mAb and baseline stability. The dissociation phase for all concentrations of human and cyno CD33-HSA was monitored at a flow rate of 100 µL/min for 15 minutes for binding to C33B782, 60 minutes for binding to C33B912 (identical to C33B904 with hIgG4), followed by regeneration using an 18 second pulse of 0.85% phosphoric acid to remove the antigen and the bound mAb. The raw biding data were processed by double referencing after subtracting the response data from: 1) the inter-spot to correct for the non-specific interactions between the Ag and the empty chip surface; 2) the buffer channel to correct for baseline drifting due to the dissociation of captured mAb surface over time. The processed data at all antigen concentrations for each mAb were globally fit to a 1:1 simple Langmuir binding model to extract estimates of the kinetic ($k_{on}$, $k_{off}$) and affinity ($K_d$) constants.

To determine whether the panel of mAbs all bind 1 distinct epitope or if there was broad epitope coverage, an epitope binning experiment was performed. Competitive epitope binning of CD33 mAbs was performed on an IBIS SPRi instrument (Carterra) using a CMD-200M sensor prism chip. Each anti-CD33 antibody was directly immobilized via amine coupling on the chip at 10 µg/ml in acetate buffer (pH 4.5) using a separate Continuous Flow Microspotter (CFM). Printed sensor chip was then transferred to the IBIS instrument for the binning analyses using a Classical or "Sandwich" binning format. Binning was performed by sequential injection of human CD33 ECD-HSA, (C33W2) at 50 nM followed by a single anti-CD33 mAb injection as competing analyte in solution at 133 nM to bind immobilized anti-CD33 mAbs with surface regeneration after each sequential injection cycle of antigen and antibody.

To monitor the activity of the immobilized mAbs before and after regeneration, a buffer injection without any competing mAb was performed at the beginning and at the end of the experiment to measure the antigen alone binding activity. The response of competing mAb binding relative to the buffer (antigen alone) binding is an indication whether the antibody in solution blocks or sandwiches the antigen binding to the immobilized mAbs. The raw binning data (.trix file format) were referenced and zeroed using SprintX software (Wasatch, Ver 1.9.3.2), then exported (.ibmx file format) to the binning software HtTools.exe (Wasatch, version 2.0.0.33) for analyses. Data were curated by removing antibodies with antigen responses below 20 RU, and antibodies that did not self-block. Competing mAb responses were normalized relative to the antigen alone binding response. Antibodies with normalized responses <0.25 were denoted blockers, those with normalized responses ≥0.25 were denoted as non-blockers/Sandwichers. Different bins were predicted using a cut at height 2.5 on the combined dendrogram plot.

The table below summarizes the full kinetic analysis and epitope binning of 32 select mAbs. There are a total of 8 anti-CD33 mAbs that have sub-nanomolar affinity for both human and cyno CD33 and these mAbs correspond to 3 distinct epitope bins while the larger panel has a range of affinities and 7 distinct epitope bins.

TABLE 47

Full Kinetics Analysis and Epitope Binning of OMNIRat derived mAbs

Human CD33 ECD-HSA

| Prot. AA ID | V Region ID | ka (1/Ms) | $k_d$ (1/s) | $K_D$ (M) | Epitope Bin |
|---|---|---|---|---|---|
| C33B48 | C33F53 | 1.62E+06 | 1.82E−05 | 1.12E−11 | 1 |
| C33B46 | C33F51 | 1.45E+06 | 1.99E−03 | 1.38E−09 | 1 |
| C33B66 | C33F71 | 3.85E+04 | 2.03E−03 | 5.29E−08 | 1 |
| C33B107 | C33F112 | binding/no fit | binding/no fit | binding/no fit | 1 |
| C33B88 | C33F93 | binding/no fit | binding/no fit | binding/no fit | 1 |
| C33B96 | C33F101 | 2.26E+05 | 4.36E−04 | 1.92E−09 | 3 |
| C33B101 | C33F106 | 1.62E+06 | 1.08E−03 | 6.64E−09 | 3 |
| C33B73 | C33F78 | 5.59E+05 | 5.59E−05 | 1.00E−10 | 4 |
| C33B125 | C33F130 | 9.92E+05 | 1.34E−04 | 1.40E−10 | 4 |
| C33B55 | C33F60 | 9.85E+05 | 2.53E−04 | 2.60E−10 | 4 |
| C33B82 | C33F87 | 4.45E+05 | 2.70E−04 | 6.10E−10 | 4 |
| C33B83 | C33F88 | 2.70E+05 | 5.21E−04 | 1.93E−09 | 4 |
| C33B75 | C33F80 | 3.85E+05 | 4.41E−03 | 1.14E−08 | 4 |
| C33B123 | C33F128 | 1.02E+06 | 1.52E−02 | 1.48E−08 | 4 |
| C33B52 | C33F57 | 2.06E+05 | 3.96E−03 | 1.92E−08 | 4 |
| C33B61 | C33F66 | 4.89E+05 | 1.05E−02 | 2.14E−08 | 4 |
| C33B62 | C33F67 | 5.07E+05 | 1.26E−02 | 2.49E−08 | 4 |
| C33B64 | C33F69 | 4.33E+05 | 2.21E−03 | 5.10E−09 | 4 |
| C33B63 | C33F68 | 5.33E+05 | 3.74E−03 | 7.01E−09 | 4 |
| C33B122 | C33F127 | 7.47E+05 | 7.12E−03 | 9.53E−09 | 4 |
| C33B72 | C33F77 | 8.71E+05 | 2.00E−04 | 2.30E−10 | 5 |
| C33B79 | C33F84 | 5.15E+05 | 3.90E−04 | 7.60E−10 | 5 |
| C33B77 | C33F82 | 8.28E+05 | 2.62E−04 | 3.20E−10 | 6 |
| C33B87 | C33F92 | 7.20E+05 | 4.32E−04 | 6.00E−10 | 6 |
| C33B94 | C33F99 | 9.22E+05 | 5.85E−04 | 6.30E−10 | 6 |
| C33B95 | C33F100 | 4.82E+05 | 7.40E−03 | 1.54E−08 | 6 |
| C33B120 | C33F125 | 5.75E+05 | 1.68E−03 | 2.93E−09 | 6 |
| C33B89 | C33F94 | low binding | low binding | low binding | 8 |
| C33B54 | C33F59 | low binding | low binding | low binding | 9 |
| C33B124 | C33F129 | 3.57E+05 | 1.24E−04 | 3.50E−10 | NB |
| C33B80 | C33F85 | 3.23E+05 | 4.25E−04 | 1.32E−09 | NB |
| C33B56 | C33F61 | low binding | low binding | low binding | NB |

Cyno CD33 ECD-HSA

| Prot. AA ID | V Region ID | ka (1/Ms) | $k_d$ (1/s) | $K_D$ (M) | Epitope Bin |
|---|---|---|---|---|---|
| C33B48 | C33F53 | 4.31E+06 | 1.58E−04 | 3.66E−11 | 1 |
| C33B46 | C33F51 | 2.97E+06 | 3.75E−04 | 1.26E−10 | 1 |
| C33B66 | C33F71 | 1.22E+06 | 2.66E−04 | 2.17E−10 | 1 |
| C33B107 | C33F112 | 3.31E+05 | 7.01E−05 | 2.12E−10 | 1 |
| C33B88 | C33F93 | binding/no fit | binding/no fit | binding/no fit | 1 |
| C33B96 | C33F101 | binding/no fit | binding/no fit | binding/no fit | 3 |
| C33B101 | C33F106 | 2.25E+05 | 2.69E−04 | 1.20E−09 | 3 |
| C33B73 | C33F78 | 6.00E+05 | 5.08E−04 | 8.46E−10 | 4 |
| C33B125 | C33F130 | 1.12E+06 | 3.39E−04 | 3.04E−10 | 4 |
| C33B55 | C33F60 | 1.16E+06 | 8.37E−05 | 7.23E−11 | 4 |
| C33B82 | C33F87 | 5.45E+05 | 7.51E−04 | 1.38E−09 | 4 |
| C33B83 | C33F88 | 2.47E+05 | 2.88E−03 | 1.17E−08 | 4 |
| C33B75 | C33F80 | 6.16E+05 | 1.32E−03 | 2.15E−09 | 4 |
| C33B123 | C33F128 | 1.26E+06 | 3.39E−03 | 2.69E−09 | 4 |
| C33B52 | C33F57 | 3.13E+05 | 1.48E−03 | 4.74E−09 | 4 |
| C33B61 | C33F66 | 7.34E+05 | 1.62E−03 | 2.21E−09 | 4 |
| C33B62 | C33F67 | 8.05E+05 | 1.49E−03 | 1.85E−09 | 4 |
| C33B64 | C33F69 | 5.90E+05 | 1.01E−03 | 1.71E−09 | 4 |
| C33B63 | C33F68 | 7.23E+05 | 8.80E−04 | 1.22E−09 | 4 |
| C33B122 | C33F127 | binding/no fit | binding/no fit | binding/no fit | 4 |
| C33B72 | C33F77 | 9.19E+05 | 5.40E−04 | 5.87E−10 | 5 |
| C33B79 | C33F84 | 5.48E+05 | 2.20E−03 | 4.01E−09 | 5 |
| C33B77 | C33F82 | 1.08E+06 | 2.66E−04 | 2.47E−10 | 6 |
| C33B87 | C33F92 | 1.12E+06 | 2.64E−04 | 2.36E−10 | 6 |
| C33B94 | C33F99 | 1.10E+06 | 5.20E−04 | 4.73E−10 | 6 |
| C33B95 | C33F100 | 8.44E+05 | 8.06E−03 | 9.56E−09 | 6 |
| C33B120 | C33F125 | 8.76E+05 | 9.02E−04 | 1.03E−09 | 6 |
| C33B89 | C33F94 | 2.65E+05 | 2.01E−04 | 7.60E−10 | 8 |
| C33B54 | C33F59 | 1.32E+06 | 6.37E−04 | 4.84E−10 | 9 |
| C33B124 | C33F129 | 4.67E+05 | 4.72E−04 | 1.01E−09 | NB |
| C33B80 | C33F85 | 4.92E+05 | 2.59E−04 | 5.27E−10 | NB |
| C33B56 | C33F61 | low binding | low binding | low binding | NB |

The OmniMouse panel (8 mAbs total) was generated separately and characterized further for binding to cells. Cell binding was performed as described above and summarized in the table below. Of the 8 mAbs tested 6 bound directly to CD33 expressing cells while 2 did not.

(C33B911 and C33B912) both binned with clones from bin 4 above (bin 4 in this experiment) while the subnanomolar clone (C33B916) binned into 2 here along with C33B836 (bin 1 in the above experiment).

TABLE 48

Cell Binding of OMNIMouse derived mAbs to human and cyno expressing cell lines

| mAb | Parental | | | | Human CD33 | | | |
|---|---|---|---|---|---|---|---|---|
| | 60 nM | 6 nM | 0.6 nM | 0 nM | 60 nM | 6 nM | 0.6 nM | 0 nM |
| C33B909 | 253.50 | 206.04 | 169.77 | 119.51 | 176.49 | 170.25 | 154.00 | 191.28 |
| C33B910 | 193.52 | 176.14 | 108.46 | 190.17 | 213.55 | 183.33 | 151.25 | 155.29 |
| C33B911 | 1466.02 | 389.41 | 186.22 | 113.30 | 237954.27 | 100333.48 | 13501.02 | 114.07 |
| C33B912 | 977.91 | 273.07 | 140.62 | 124.53 | 237140.86 | 101295.70 | 15726.96 | 149.54 |
| C33B913 | 174.49 | 118.08 | 123.26 | 129.07 | 518952.00 | 409071.06 | 204694.14 | 127.82 |
| C33B914 | 181.37 | 142.74 | 139.10 | 113.48 | 304350.88 | 315129.56 | 153252.58 | 185.45 |
| C33B915 | 101.28 | 147.65 | 143.51 | 100.00 | 390477.25 | 362902.66 | 138398.56 | 112.22 |
| C33B916 | 416.08 | 145.16 | 115.70 | 91.75 | 447815.47 | 404033.19 | 192941.55 | 167.07 |

| mAb | Cyno CD33 | | | |
|---|---|---|---|---|
| | 60 nM | 6 nM | 0.6 nM | 0 nM |
| C33B909 | 180.33 | 135.33 | 115.73 | 124.03 |
| C33B910 | 202.42 | 135.18 | 116.71 | 175.97 |
| C33B911 | 17036.56 | 7729.14 | 1935.16 | 97.94 |
| C33B912 | 15070.88 | 7271.38 | 1726.03 | 124.69 |
| C33B913 | 40661.90 | 36920.95 | 35224.10 | 106.19 |
| C33B914 | 44964.85 | 33368.26 | 22086.01 | 86.76 |
| C33B915 | 37495.34 | 35692.21 | 36165.59 | 113.92 |
| C33B916 | 41004.43 | 33294.78 | 22790.61 | 104.43 |

The 6 mAbs that bound CD33 on cells were further characterized biophysically via full kinetic analysis to recombinant antigen using the methods described above and summarized in the table below. Of the 6 mAbs tested, 1 bound to human CD33 with a picomolar affinity (C33B912) and subnamolar for cyno CD33, while 1 had very strong affinity for human CD33 but only nanomolar affinity towards cyno CD33 (C33B911). Two more clones were subnanomolar for both human and cyno CD33 (C33B913 and C33B916), but neither affinity was in the range of C33B912.

TABLE 49

Full Kinetics Analysis of OMNIMouse derived mAbs

| mAb | Human CD33 ECD-HSA | | | Cyno CD33 ECD-HSA | | |
|---|---|---|---|---|---|---|
| | $k_a$ (1/Ms) | $k_d$ (1/s) | $K_D$ (M) | $k_a$ (1/Ms) | $k_d$ (1/s) | $K_D$ (M) |
| C33B911 | 1.10E+06 | 4.14E−05 | 3.78E−11 | 1.15E+06 | 1.15E−03 | 1.00E−09 |
| C33B912 | 1.42E+06 | 4.29E−05 | 3.02E−11 | 1.50E+06 | 6.50E−04 | 4.33E−10 |
| C33B913 | 6.60E+05 | 6.40E−04 | 9.69E−10 | 2.56E+06 | 3.08E−04 | 1.20E−10 |
| C33B914 | 4.44E+05 | 9.80E−03 | 2.21E−08 | 5.29E+05 | 2.33E−04 | 4.40E−10 |
| C33B915 | 2.18E+05 | 9.89E−04 | 4.53E−09 | 3.81E+06 | 8.93E−05 | 2.34E−11 |
| C33B916 | 6.27E+05 | 4.11E−04 | 6.55E−10 | 4.73E+05 | 4.03E−04 | 8.52E−10 |

An epitope binning experiment was performed on the 6 cell binding mAbs derived from OMNIMouse along with several control mAbs previously identified in the earlier OMNIRat campaign. The control mAbs were chosen based on their subnanomolar affinity towards human CD33 and the number of distinct epitope bins. The binning software HtTools assigns Epitope Bin numbers on a per experiment basis and therefore having several controls to already defined epitope bins was critical for cross-comparison. The two OMNIMouse derived human CD33 high affinity clones

TABLE 50

Epitope Bins of OMNIMouse anti-CD33 mAbs

| mAb | V region ID | Epitope Bin |
|---|---|---|
| C33B915 | C33F553 | 1 |
| C33B916 | C33F554 | 2 |
| C33B836 | C33F53 | 2 |
| C33B914 | C33F552 | 2 |
| C33B913 | C33F551 | 3 |
| C33B806 | C33F106 | 3 |

TABLE 50-continued

Epitope Bins of OMNIMouse anti-CD33 mAbs

| mAb | V region ID | Epitope Bin |
|---|---|---|
| C33B911 | C33F549 | 4 |
| C33B912 | C33F550 | 4 |
| C33B778 | C33F78 | 4 |
| C33B830 | C33F130 | 4 |
| C33B782 | C33F82 | 5 |

TABLE 50-continued

Epitope Bins of OMNIMouse anti-CD33 mAbs

| mAb | V region ID | Epitope Bin |
|---|---|---|
| C33B792 | C33F92 | 5 |
| C33B799 | C33F99 | 5 |
| C33B760 | C33F60 | 6 |
| C33B777 | C33F77 | 7 |

CD33 is comprised of 2 IgG domains, the membrane distal V domain and the membrane proximal C2 domain. The SNP rs12459419 can cause the selective alternative splicing of the CD33 pre-mRNA transcript to yield a C2 only form expressed on cells and therefore targeting this domain can provide clinical benefit. To ascertain which of the two domains, the mAbs were capable of binding, an off-rate screen was performed following the protocol above on 6 mAbs with the highest binding capability that covered 4 distinct epitope bins using Human CD33 ECD-HSA, Human CD33 V-HSA and Human CD33 C2-HSA as the binding antigens. As shown in the table below, the two clones previously grouped in bin 4 both bound to the huCD33 C2 domain but not the huCD33 V domain, while the clones in bin 2 and 3 bound the V domain but not the C2 domain. Two clones grouped into bin 5 did not bind either domain, and, therefore, their exact binding location could span the two domains. Three (3) commercially available mAbs were included in this experiment ((WM53 (EMD Millipore; Darmstadt, Germany), P67.7 (Biolegend, San Diego, Calif.), and LSBio clone 906 (LifeSpan Biosciences, Seattle, Wash.))) and all showed binding to the V domain, but not the C2 domain. Looking at the epitope bins in Tables 42 and 45 in relation to the C2 domain binding data in Table 51, there are a total of 15 mAbs that could potentially bind the C2 domain ranging in affinities from ~25 nM to ~30 pM on the human full length protein.

TABLE 51

Off-rate Domain Binding

| Protein ID | huCD33 ECD-HSA $k_d$ (1/s) | huCD33-V-HSA $k_d$ (1/s) | huCD33-C2-HSA $k_d$ (1/s) | Epitope Bin |
|---|---|---|---|---|
| C33B912 | 1.29E−05 | No/low binding response | 6.68E−05 | 4 |
| C33B778 | 4.72E−05 | No/low binding response | 2.57E−03 | 4 |
| C33B782 | 2.58E−04 | No/low binding response | No/low binding response | 5 |
| C33B792 | 4.27E−04 | No/low binding response | No/low binding response | 5 |
| C33B836 | 5.52E−05 | 3.71E−05 | No/low binding response | 2 |
| C33B806 | 1.36E−03 | 3.18E−03 | No/low binding response | 3 |
| WM53 | 2.37E−03 | 3.78E−02 | No/low binding response | |
| P67.7 | 1.05E−03 | 2.43E−03 | No/low binding response | |
| LSBio clone 906 | 2.45E−03 | 4.34E−02 | No/low binding response | |

To support further in vivo and in vitro studies, select clones (C33B836, C33B782, C33B778, C33B904, C33B806, C33B830, C33B937, C33B792, C33B760, and C33B777) were chosen for scale-up and fab arm exchange to produce bi-specific molecules with anti-CD3 antibodies. ExpiCHO-S™ cells (ThermoFisher Scientific) were seeded at $1.25 \times 10^5$-$2.25 \times 10^5$ viable cells/mL in ExpiCHO™ Expression Medium and cultured in polycarbonate, disposable, sterile, vented, non-baffled Erlenmeyer shake flasks in a 37° C., 700 $CO_2$ shaker incubator (INFORS HT Multitron Pro). For routine cell growth in 125 mL-2 L shake flasks, the shake speed was set to 130 rpm for shakers with a 19 mm shaking diameter. Cells were sub-cultured when the density reached log phase growth at $4 \times 10^6$-$6 \times 10^6$ viable cells/mL with a 98-99% viability.

Two days before transfection, ExpiCHO-S™ cells were seeded at $1.5 \times 10^6$ viable cells/mL for the required culture volume. On the day of transfection, the viable cell density and percent viability was determined. Cells were transfected at a density of $6 \times 10^6$ viable cells/mL. For optimal transfection, sterile heavy and light chain plasmid DNA at ≥1 mg/mL concentration in TE buffer (10 mM Tris-HC1, 1 mM EDTA, pH 8.0) was used.

ExpiCHO-S™ cells were transfected following manufacturer's Max Titer Transfection protocol (ThermoFisher Publication Number MAN0014337). All amounts and volumes shown below were per mL of the final transfected culture volume. Briefly, plasmid DNA was diluted with 0.04 mL cold OptiPRO™ medium (ThermoFisher Scientific) at the following ratio: 0.125 µg Heavy Chain DNA: 0.375 µg Light Chain DNA: 0.5 µg pAdvantage. 6.4 µL of ExpiFectamine™ CHO Transfection Reagent was diluted and mixed gently with 0.04 mL cold OptiPRO™ medium and incubated for 1 min. The diluted ExpiFectamine™ CHO Reagent was added to the diluted DNA, mixed gently and the ExpiFectamine™ CHO/plasmid DNA complexes were incubated at room temperature for 5 minutes. Post-incubation, the complexes were added to the ExpiCHO-S™ cells in a shaker flask and incubated overnight in a 37° C., 7% $CO_2$ shaker incubator.

For the Max Titer protocol, on Day 1 post-transfection, 6 µL ExpiFectamine™ CHO Enhancer and 160 µL ExpiCHO™ Feed were added and the flask was transferred to a 32° C., 7% $CO_2$ shaker incubator. On Day 5 post-transfection, 160 µL of ExpiCHO™ Feed was added for the second time to the flask and returned to the 32° C. incubator with shaking. The culture was harvested on Day 12 post-transfection, centrifuged at 5000 rpm for 15 mins and clarified through a 0.2 um Acropak 1500 filter capsule (Pall).

Expressed antibodies were purified from the clarified supernatants using MabSelect SuRe (GE Healthcare). MabSelect SuRe Protein A columns were equilibrated with 1×D-PBS, pH 7.2 prior to loading individual culture supernatants. Unbound proteins were removed by washing extensively with 1×D-PBS, pH 7.2. Bound proteins were eluted with 0.1 M Na-acetate, pH 3.5. Peak fractions were neutralized with 2.5M Tris pH 7.2 and pooled. The neutralized fraction pools were either dialyzed into 1×dPBS for assays and biophysical characterization or utilized for bispecific assembly.

The protein concentration for each elution pool was determined by measuring absorbance at OD280 nm and calculated using absorbance extinction coefficient based on the amino acid sequence.

6 Preparation and Functional Evaluation of CD33×CD3 Bispecific Antibodies 6-1 Fab-Arm Exchange Using Purified Parental mAbs The formation of the CD33×CD3 bispecific antibodies requires two parental mAbs, one specific for the targeting arm (e.g. CD33) and one specific for the effector arm (e.g. CD3). CD33 mAbs were recombined with a high affinity (CD3B376: VH of SEQ ID NO: 652, and VL of SEQ IF NO: 661) or low affinity CD3 arm (CD3B450: VH of SEQ ID NO: 657, and VL of SEQ IF NO: 678) arms. These parental mAbs (CD33 and CD3 arms) are in the IgG4 PAA format (Labrijn et al, 2013) where the targeting parent (CD33) contains the 409R Genmab mutation (native amino acid for IgG4), while the killing parent (CD3) contains the F405L mutation and R409K. The monospecific anti-CD3 antibody was expressed as IgG4, having Fc substitutions S228P, F234A, L235A, F405L, and R409K (CD3 arm) (numbering according to EU index) in their Fc regions. The monospecific antibodies were expressed and purified as described above. Post purification the parental CD33 antibodies were mixed with the desired parental CD3 antibody under reducing conditions in 75 mM 2-MEA (2-Mercaptoethylamine) and incubated at 31° C. for 5 hours or at room temperature overnight. The recombination reactions were based on molar ratios, where a set amount of CD33 antibody (e.g., 10 mg, or ~74.6 nanomoles) was combined with CD3 antibody (e.g., ~67.8 nanomoles), where the CD33 antibody was added in a 6% excess of the CD3 antibody. The concentrations of the CD33 antibody stocks varied from 0.8 to 6 mg/mL, and the volumes of the recombination reactions varied for each pairing. The recombination reactions were subsequently dialyzed overnight against PBS to remove the reductant. The CD33×CD3 bispecific antibody reactions were performed with an excess of the CD33 antibody (ratio) to minimize the amount of unreacted CD3 parental antibody remaining after recombination.

The final CD33×CD3 bispecific antibodies produced, along with the parental mAbs (i.e. CD33, CD3, or Null) used in the recombination reactions are listed in Table 47.

Selected CD33 hits were also paired with a non-killing arm (Null) to create negative controls for testing purposes. For control bispecific antibodies, B2M1, an RSV antibody in the IgG4 PAA format was generated, purified and, combined with either the CD3 arms CD3B219 or CD3B376-F405L, R409K to generate CD3B288 (CD3×Null) and CD3B510 (CD3B376×Null), respectively; CD33 arms were combined with B23B49 to generate CD33×Null, as in Table 52.

TABLE 52

CD33 x CD3 bispecific antibodies

| Bispecific Ab | Parental | HC Pep ID | VH Pep SEQ ID | LC Pep ID | VL Pep SEQ ID |
|---|---|---|---|---|---|
| C3CB7 | C33B836 | C33H80 | 267 | C33L73 | 306 |
| | CD3B219 | CD3H141 | 247 | CD3L66 | 287 |
| C3CB5 | C33B830 | C33H84 | 269 | C33L66 | 308 |
| | CD3B219 | CD3H141 | 247 | CD3L66 | 287 |
| C3CB4 | C33B806 | C33H69 | 260 | C4LL152 | 300 |
| | CD3B219 | CD3H141 | 247 | CD3L66 | 287 |
| C3CB16 | C33B799 | C33H98 | 275 | C33L69 | 314 |
| | CD3B219 | CD3H141 | 247 | CD3L66 | 287 |
| C3CB14 | C33B792 | C33H87 | 270 | C33L35 | 309 |
| | CD3B219 | CD3H141 | 247 | CD3L66 | 287 |
| C3CB12 | C33B782 | C33H72 | 262 | C33L40 | 301 |
| | CD3B219 | CD3H141 | 247 | CD3L66 | 287 |
| C3CB11 | C33B778 | C33H66 | 258 | C33L60 | 298 |
| | CD3B219 | CD3H141 | 247 | CD3L66 | 287 |
| C3CB10 | C33B777 | C33H65 | 257 | C33L47 | 297 |
| | CD3B219 | CD3H141 | 247 | CD3L66 | 287 |
| C3CB8 | C33B760 | C33H45 | 250 | C33L11 | 290 |
| | CD3B219 | CD3H141 | 247 | CD3L66 | 287 |
| C3CB97 | C33B836 | C33H80 | 267 | C33L73 | 306 |
| | CD3B376 | CD3H219 | 652 | CD3L150 | 661 |
| C3CB98 | C33B830 | C33H84 | 269 | C33L66 | 287 |
| | CD3B376 | CD3H219 | 652 | CD3L150 | 661 |
| C3CB99 | C33B806 | C33H69 | 260 | C4LL152 | 300 |
| | CD3B376 | CD3H219 | 652 | CD3L150 | 661 |

TABLE 52-continued

CD33 x CD3 bispecific antibodies

| Bispecific Ab | Parental | HC Pep ID | VH Pep SEQ ID | LC Pep ID | VL Pep SEQ ID |
|---|---|---|---|---|---|
| C3CB100 | C33B799 | C33H98 | 275 | C33L69 | 314 |
| | CD3B376 | CD3H219 | 652 | CD3L150 | 661 |
| C3CB101 | C33B792 | C33H87 | 270 | C33L35 | 309 |
| | CD3B376 | CD3H219 | 652 | CD3L150 | 661 |
| C3CB102 | C33B782 | C33H72 | 262 | C33L40 | 301 |
| | CD3B376 | CD3H219 | 652 | CD3L150 | 661 |
| C3CB103 | C33B778 | C33H66 | 258 | C33L60 | 298 |
| | CD3B376 | CD3H219 | 652 | CD3L150 | 661 |
| C3CB104 | C33B777 | C33H65 | 257 | C33L47 | 297 |
| | CD3B376 | CD3H219 | 652 | CD3L150 | 661 |
| C3CB105 | C33B760 | C33H45 | 250 | C33L11 | 290 |
| | CD3B376 | CD3H219 | 652 | CD3L150 | 661 |
| C33B941 | C33B836 | C33H80 | 267 | C33L73 | 306 |
| | B23B49 | B23H1 | 246 | B23L3 | 286 |
| C33B942 | C33B830 | C33H84 | 269 | C33L66 | 308 |
| | B23B49 | B23H1 | 246 | B23L3 | 286 |
| C33B943 | C33B806 | C33H69 | 260 | C4LL152 | 300 |
| | B23B49 | B23H1 | 246 | B23L3 | 286 |
| C33B944 | C33B799 | C33H98 | 275 | C33L69 | 314 |
| | B23B49 | B23H1 | 246 | B23L3 | 286 |
| C33B945 | C33B792 | C33H87 | 270 | C33L35 | 309 |
| | B23B49 | B23H1 | 246 | B23L3 | 286 |
| C33B946 | C33B782 | C33H72 | 262 | C33L40 | 301 |
| | B23B49 | B23H1 | 246 | B23L3 | 286 |
| C33B947 | C33B778 | C33H66 | 258 | C33L60 | 298 |
| | B23B49 | B23H1 | 246 | B23L3 | 286 |
| C33B948 | C33B777 | C33H65 | 256 | C33L47 | 297 |
| | B23B49 | B23H1 | 246 | B23L3 | 286 |
| C33B949 | C33B760 | C33H45 | 250 | C33L11 | 290 |
| | B23B49 | B23H1 | 246 | B23L3 | 286 |
| CD3B288 | B23B39 | B23H1 | 246 | B23L3 | 286 |
| | CD3B219 | CD3H141 | 247 | CD3L66 | 287 |
| CD3B510 | B23B39 | B23H1 | 246 | B23L3 | 286 |
| | CD3B376 | CD3H219 | 652 | CD3L150 | 661 |
| C3CB87 | C33B903 | C33H251 | 280 | C33L117 | 319 |
| | CD3B219 | CD3H141 | 247 | CD3L66 | 287 |
| C3CB88 | C33B904 | C33H252 | 281 | C33L118 | 320 |
| | CD3B219 | CD3H141 | 247 | CD3L66 | 287 |
| C3CB89 | C33B905 | C33H253 | 282 | C33L119 | 321 |
| | CD3B219 | CD3H141 | 247 | CD3L66 | 287 |
| C3CB90 | C33B907 | C33H255 | 284 | C33L121 | 323 |
| | CD3B219 | CD3H141 | 247 | CD3L66 | 287 |
| C3CB91 | C33B908 | C33H256 | 285 | C33L122 | 324 |
| | CD3B219 | CD3H141 | 247 | CD3L66 | 287 |
| C3CB189 | C33B904 | C33H252 | 281 | C33L118 | 320 |
| | CD3B376 | CD3H219 | 652 | CD3L150 | 661 |

Pep: Peptide;
Nuc: Nucleotide;
SEQ ID: SEQ ID NO 6-2 Ex Vivo CD33×CD3 Mediated Reduction of AML Blasts and T Cell Activation in an AML Primary Sample To further assess the cytotoxicity potential of CD33×CD3 bispecific antibodies, an ex vivo cytotoxicity assay was performed using AML patient whole blood using the top four antibodies (FIG. 61). In this assay, various bispecific antibodies (CD33 antibodies paired with either CD3 arm CD31B219 and CD3B376) were added to diluted whole blood from AML patients for a period of 48 hours without providing additional T-cells, since this assay relies on the presence of autologous T-cells in the patient's blood. At 48 hours, the samples were stained with CD3 PerCPCy5.5, CD25 PE, CD33 FITC and CD38 APC (all antibodies were purchased from Biolegend; San Diego, Calif.). The samples were then washed at least 3 times in 1× Lyse RBC Lysis Buffer (eBioscience). The samples were then stained with the LIVE/DEAD® Fixable Near-IR Dead Cell Stain buffer (Life Technologies). The extent of tumor cytotoxicity was determined by first quantifying the live CD33$^+$ cells in the fraction of AML patient cancer cells (defined as CD3$^-$ CD38+ cells) in the presence of the bispecific antibodies. Cytotoxicity was calculated as a percentage relative to PBS/untreated control using the following equation: (% CD33+ in PBS/untreated control-% CD33+ in treated sample)/(% CD33+ in PBS/untreated control). T cell activation was calculated as a percentage of CD25+ events in CD3+ fraction.

As shown in FIG. 61, all CD33 lead antibodies paired with either CD3 arm (CD3B376 and CD3B219) promoted a dose-dependent reduction of total cytotoxicity that correlated with T cell activation after 48 hours. Null arm control antibodies (NullxCD3B219 and nullxCD3B376) failed to show tumor cell cytotoxicity or T cell activation. This result also demonstrated that the CD33×CD3 bispecific antibodies work in an autologous setting. These results are representative of 4 other AML donor samples (data not shown). Table 53 summarizes the $EC_{50}$ values generated with the CD33× CD3 multispecific antibodies. As seen from the $EC_{50}$ values, C33B904 paired with either CD3 arm (C3CB88, C3CB189) as well C33B836 paired with either CD3 arm (C3CB7, C3CB97) were the most potent and efficacious antibodies. These 4 antibodies were thus the focus of further characterization.

TABLE 53

CD33 × CD3 T-cell mediated ex vivo cytotoxicity assays. Summary of the $EC_{50}$ values for 8 CD33 × CD3 bispecific antibodies

| Bispecifc Ab ID | Primary AML Cell Killing $EC_{50}$ (nM) |
| --- | --- |
| C3CB11 | 3.958 |
| C3CB12 | 2.635 |
| C3CB7 | 0.3315 |
| C3CB88 | 0.6722 |
| C3CB103 | 4.186 |
| C3CB102 | 4.973 |
| C3CB97 | ~0.2316 |
| C3CB189 | 0.5782 |

6-3 Demonstration that the CD33×CD3 Bispecific Antibodies Bind to the C2 Domains of CD33 and Induce Cytotoxicity of CD33 Single Nucleotide Polymorphism (SNP) Expressing Cell Lines In Vitro T Cell Mediated Cytotoxicity Assays with CD33× CD3 Bispecific Antibodies Recent studies showed that a single nucleotide polymorphism (SNP) rs12459419 was present in ~50% of the AML population and leads to skipping of exon 2 of CD33 which results in the deletion of the V domain of CD33. This study also showed that Mylotarg which binds to the V domain of CD33, had no efficacy in patients that express the SNP, and, therefore, reduced risk of relapse and improved survival in ~50% of the AML population (Lamba et al 2017, JCO, CD33 Splicing Polymorphism Determines Gemtuzumab Ozogamicin Response in De Novo Acute Myeloid Leukemia: Report From Randomized Phase III Children's Oncology Group Trial AAML0531). Given the data with Mylotarg in the above mentioned study, in vitro T cell mediated cytotoxicity assays were performed to assess whether CD33 hits (V binding C33B836 vs C2 binding C33B904) paired with CD3 arms (CD3B219 or CD3B376) mediate killing of SNP rs12459419 expressing cell lines. Briefly, effector cells (pan T cells purchased from Biological Speciality) were harvested, counted, washed, and resuspended to 1×10⁶ cells/ml in RPMI (Invitrogen) with 10% FBS (Invitrogen) cell media. Target cells (KG1, SH2 and OCIAML3) were labeled with CFSE (Invitrogen) and resuspended to 2×10⁵ cells/mL in RPMI with 10% FBS. KG1, SH2 and OCIAML3 were chosen to represent wildtype, heterozygous and homozygous for the CD33 SNP rs12459419 mutation, respectively. Effectors and CFSE-labeled target cells were mixed at effector:target ratio (E:T)=5:1 in sterile 96-well round bottom plates. 10 µl of Fc block (ReoPro Fc fragment) along with 5 µL aliquot of bispecific antibody was added to each well containing various concentrations. Cultures were incubated at 37° C. for 48 hours under 5% C02. After 48 hrs, the LIVE/DEAD® Fixable Near-IR Dead Cell Stain buffer (Life Technologies) was added to samples and cultures were incubated for 20 min in the dark at RT, washed, and resuspended in 100-200 µL FACs buffer. The drug-induced cytotoxicity was determined using CANTO II flow cytometer (BD Biosciences) and analyzed with FlowJo Software or Dive software (BD Biosciences). The population of interest is the double positive CFSE+/live/dead+ cells. As shown in FIG. 62, unlike the null arm controls (nullx CD3B219 and nullxCD3B376), V binding and C2 binding CD33×CD3 multispecific antibodies induced T cell redirected cell cytotoxicity of CD33+ WT for SNP rs12459419 mutation cell line KG1 at 48 hrs. In contrast, unlike V binder C33B836 (C3CB97, C3CB7), only the C2 binding C33B904 paired bispecific antibodies (C3CB189, C3CB88) mediated cytotoxicity of SH2 and OCIAML3 cell lines that were heterozygous or homozygous for the rs12459419 SNP mutations, respectively. For this reason, C33B904 paired bispecific antibodies (C3CB189, C3CB88) were taken forward for further analysis and characterization. Collectively, these data suggest that CD33 C2 binding bispecific antibodies such as C33B904 paired bispecific antibodies have the potential to show efficacy in a broader group of AML patients than V binding competitor anti-CD33 antibodies.

6-4 Ex Vivo CD33×CD3 Mediated Reduction of Spiked in MOLM-13 and Monocytes in an Ex Vivo Whole Blood MOLM-13 Cytotoxicity Assay To assess the cytotoxicity potential of CD33×CD3 bispecific antibodies at eliminating spiked in MOLM-13 cells and normal human monocytes, an ex vivo cytotoxicity assay using normal healthy human whole blood with exogenously added CD33+ AML cell line MOLM-13 was utilized. Similar to the above experiment, various bispecific antibodies (CD33 antibodies paired with either CD3 arm CD3B219 and CD3B376) were added to diluted whole blood from 6 different normal human donors for a period of 48 hr without providing additional T-cells, since this assay relies on the presence of autologous T-cells in the donor's blood. Prior to dilution, the concentration of T cells in the blood of each donor was enumerated. The blood was then diluted with CFSE (Invitrogen) labeled MOLM-13 cells, such that effector:target ratio (E:T) is 1:5 to mimic the effector:target ratio in AML patient samples. At 48 hs, the samples were stained with CD3 PerCPCy5.5, CD25 PE, CD33 FITC and CD14 Pacific Blue (all antibodies were purchased from Biolegend). The samples were then washed at least 3 times in 1× Lyse RBC Lysis Buffer (eBioscience). The samples were then stained with the LIVE/DEAD® Fixable Near-IR Dead Cell Stain buffer (Life Technologies). The extent of tumor cytotoxicity was determined by first quantifying the live CD33+ cells in the fraction of CD14 monocytes in the presence of the bispecific antibodies. Cytotoxicity of MOLM-13 cells was determined by enumerating the percentage of dead CFSE+ cells. Cytotoxicity of monocytes was calculated as a percentage relative to PBS/untreated control using the following equation: (% CD33+ CD14+ in PBS/untreated control-% CD33+ CD14+ in treated sample)/(% CD33+ CD14+ in PBS/untreated control). The data in FIG.

63 indicate that both CD33×CD3 bispecific antibodies (same CD33 lead C33B904 paired with either CD3 arm, CD3B376 and CD3B219) specifically induce cell cytotoxicity of MOLM-13 cells and CD33+ monocytes at 48 hr. The null arm controls were used as negative bispecific antibody controls. The null arm control showed little-to-no cytotoxicity activity of the MOLM-13 and CD33+ monocytes. These data show the average values of 6 different normal donors. The average $EC_{50}$ values for cytotoxicity of MOLM-13 and CD14+ monocytes are shown in Table 54.

TABLE 54

CD33 × CD3 T-cell mediated ex vivo cytotoxicity assays. Summary of $EC_{50}$ values for 2 CD33 × CD3 bispecific antibodies.

| Bispecific Ab ID | MOLM13 Killing $EC_{50}$ (nM) | CD33+ CD14+ Killing $EC_{50}$ (nM) |
| --- | --- | --- |
| C3CB189 | 0.1677 | 1.156 |
| C3CB88 | 0.671 | 0.506 |

6-5 Demonstration of Species Cross-Reactivity of CD33×CD3 Bispecific Antibodies to Cynomolgus Monkey Ex Vivo CD33×CD3 Mediated Reduction of Monocytes in an Ex Vivo Cytotoxicity Assay with Cynomolgous Whole Blood To demonstrate functional cross-reactivity and to assess the cytotoxicity potential of CD33×CD3 bispecific antibodies at eliminating normal cynomolgous monocytes, an ex vivo cytotoxicity assay using healthy cynomolgous whole blood was utilized. Similar to the above experiment, various bispecific antibodies (CD33 antibodies paired with either CD3 arm CD3B219 and CD3B376) were added to diluted whole blood from 6 different normal cynomolgous monkey donors for a period of 48 hr without providing additional T-cells, since this assay relies on the presence of autologous T-cells in the donor's blood. At 48 hrs, the samples were stained with CD3 PerCPCy5.5, CD25 PE, CD33 FITC and CD14 Pacific Blue (all antibodies were purchased from Biolegend except for the CD33 antibody which was purchased from Miltenyi; Bergisch Gladbach, Germany). The samples were then washed at least 3 times in 1× Lyse RBC Lysis Buffer (eBioscience) prior to staining with the LIVE/DEAD® Fixable Near-IR Dead Cell Stain buffer (Life Technologies). The extent of monocyte cytotoxicity was determined by first quantifying the live CD33+ cells in the fraction of CD14+ monocytes in the presence of the bispecific antibodies. Cytotoxicity was calculated as a percentage relative to PBS/untreated control using the following equation: (% CD33+ CD14+ in PBS/untreated control-% CD33+ CD14+ in treated sample)/(% CD33+ CD14+ in PBS/untreated control). T cell activation was calculated as a percentage of CD25+ events in CD3+ fraction. The data in FIG. 64 indicated that both CD33×CD3 bispecific antibodies (same CD33 lead C33B904 paired with either CD3 arm, CD3B376 and CD3B219) specifically induced cell cytotoxicity of CD33+ monocytes as well as T cell activation at 48 hr. The null arm controls were used as negative bispecific antibody controls and showed little-to-no cytotoxicity or T cell activity. Table 55 shows the average values of 6 different cynomolgous donors.

TABLE 55

CD33 × CD3 T-cell mediated ex vivo cytotoxicity assays. Summary of the $EC_{50}$ values for 2 CD33 × CD3 bispecific antibodies.

| Protein AA ID | CD33+ CD14+ Killing $EC_{50}$ (nM) | T cell activation $EC_{50}$ (nM) |
| --- | --- | --- |
| C3CB189 | 3.60 | 0.02 |
| C3CB88 | 0.89 | 0.02 |

6-6 Efficacy of C3CB189 and C3CB88 in MOLM-13 Human AML Xenografts in T Cell Humanized NSG Mice Efficacy of C3CB189 and C3CB88 was evaluated in established luciferase-transfected disseminated MOLM-13 human acute myeloid leukemia (AML) xenografts in female NOD.Cg-Prkdc$^{scid}$ Il2rg$^{tm1Wjl}$/SzJ (NSG) mice humanized with 20 million T cells. Animals were randomized into n=10/group by live bioluminescence imaging (BLI) on day 5 post-i.v. tumor implantation. C3CB189 and C3CB88 at 0.005, 0.05 and 0.5 mg/kg or Null×CD3 antibody control at 0.5 mg/kg were dosed i.p. every 3-4 days for 6 weeks.

On day 13 post-tumor implantation, when at least eight animals remained per group, tumor growth inhibition (% TGI) as determined by bioluminescence was calculated. Statistically significant tumor growth inhibition was observed with C3CB189 (FIG. 65) and C3CB88 (FIG. 67) at all concentrations, as compared to Null×CD3 control. C3CB189 at 0.005, 0.05, and 0.5 mg/kg elicited tumor growth inhibition of 76%, 100% and 82%, respectively, and C3CB88 at 0.005, 0.05, and 0.5 mg/kg elicited tumor growth inhibition of 100%, 100% and 91%, respectively, as compared to Null×CD3 treated controls.

Treatment with C3CB189 and C3CB88 resulted in reduced tumor burden and increased life span (ILS) greater than the 16-day median survival of the Null×CD3 control group. Animals treated with C3CB189 had a median survival of 19-27.5 days (FIG. 66) and animals treated with C3CB88had a median survival of 26-28.5 (FIG. 68) days across doses. C3CB189 at 0.005, 0.05, and 0.5 mg/kg resulted in an increased life span of 19%, 72% and 50%, respectively, and C3CB88 resulted in an increased life span of 63%, 78% and 72%, respectively, as compared to the control group.

7 TMEFF2 Antibodies 7-1 Antigen Generation

Human extracellular domain (ECD) TMEFF2 was produced based on UniProt Accession #Q9UIK5 sequence. The ECD construct was designed with a 6× His-tag (SEQ ID NO: 596) and Avi-tag sequences at the C-terminus (construct TMEW1; SEQ ID NO: 578). A construct containing the FS2 and EGF domains (amino acids 151-320 was designed as a human serum albumin (HSA) fusion with a 6× His-tag (SEQ ID NO: 596) and avitag sequences (construct TMEW7; SEQ ID NO: 579). A construct containing the TMEFF2 membrane proximal domain (residues 230-320) was designed with a 6×His tag (SEQ ID NO: 596) (construct TMEW19; SEQ ID NO: 580) or fused to a rat IgG1 Fc with a His-tag (construct TMEW20; SEQ ID NO: 581). Residues 230-320 of TMEFF2 contain the EGF domain which spans the residues 261-301 of TMEFF2. The human TMEFF2 ECD expression constructs were transiently transfected into HEK293 derived cells, Expi293 (Gibco/Thermo Fisher Scientific) using Expifectamine according to manufacturer protocol. Cells were incubated 5 days at 37° C. with 8% C02 on an orbital shaker before harvesting. The expressed cells were removed by centrifugation and the soluble TMEFF2 proteins with his-tags were purified from the media using immobilized metal affinity chromatography using Ni Sepharose 6 Fast Flow resin (GE Healthcare) followed by Superdex 200 preparative size exclusion chromatography (SEC) (GE Healthcare) in Dubelcco's Phosphate Saline buffer pH 7.2 (1×DPBS). The amino acid sequences of the generated antigens are shown in Table 58.

OmniRats were immunized with the human TMEFF2 construct FS2-EGF-Tev-HSA(C34S)-His-Avitag (TMEW7, SEQ ID NO: 579) and boosted with the construct spTMEFF2 (230-320)G3S-ratIgG1Fc (TMEW20, SEQ ID NO: 581). Following a 89 day immunization regimen, lymph nodes from the rats were harvested and used to generate

TABLE 58

| Protein AA ID | Description | Amino Acid Sequence |
|---|---|---|
| TMEW1 (SEQ ID NO: 578) | TMEFF2-FL-ECD-His-Avitag | FPTSLSDCQTPTGWNCSGYDDRENDLFLCDTNTCK FDGECLRIGDTVTCVCQFKCNNDYVPVCGSNGESY QNECYLRQAACKQQSEILVVSEGSCATDAGSGSGD GVHEGSGETSQKETSTCDICQFGAEVDEDAEDVWC VCNIDCSQTNFNPLCASDGKSYDNACQIKEASCQK QEKEIVMSLGRCQDNTTTTTKSEDGHYARTDYAEN ANKLEESAREHHIPCPEHYNGFCMHGKCEHSINMQ EPSCRCDAGYTGQHCEKKDYSVLYVVPGPVRFQYV GGGSHHHHHHLNDIFEAQKIEWHE |
| TMEW7 (SEQ ID NO: 579) | FS2-EGF-Tev-HSA(C34S)-His-Avitag | SGETSQKETSTCDICQFGAEVDEDAEDVWCVCNID CSQTNFNPLCASDGKSYDNACQIKEASCQKQEKIE VMSLGRCQDNTTTTTKSEDGHYARTDYAENANKLE ESAREHHIPCPEHYNGFCMHGKCEHSINMQEPSCR CDAGYTGQHCEKKDYSVLYVVPGPVRFQYVGSGSG SENLYFQGVRSSSDAHKSEVAHRFKDLGEENFKAL VLIAFAQYLQQSPFEDHVKLVNEVTEFAKTCVADE SAENCDKSLHTLFGDKLCTVATLRETYGEMADCCA KQEPERNECFLQHKDDNPNLPRLVRPEVDVMCTAF HDNEETFLKKYLYEIARRHPYFYAPELLFFAKRYK AAFTECCQAADKAACLLPKLDELRDEGKASSAKQR LKCASLQKFGERAFKAWAVARLSQRFPKAEFAEVS KLVTDLTKVHTECCHGDLLECADDRADLAKYICEN QDSISSKLKECCEKPLLEKSHCIAEVENDEMPADL PSLAADFVESKDVCKNYAEAKDVFLGMFLYEYARR HPDYSVVLLLRLAKTYETTLEKCCAAADPECYAKV FDEFKPLVEEPQNLIKQNCELFEQLGEYKFQNALL VRYTKKVPQVSTPTLVEVSRNLGKVGSKCCKHPEA KRMPCAEDYLSVVLNQLCVLHEKTPVSDRVTKCCT ESLVNRRPCFSALEVDETYVPKEFNAETFTFHADI CTLSEKERQIKKQTALVELVKHKPKATKEQLKAVM DDFAAFVEKCCKADDKETCFAEEGKKLVAASQAAL GLGGGSHHHHHHLNDIFEAQKIEWHE |
| TMEW19 (SEQ ID NO: 580) | spTMEFF2(230-320)G3S-H6 | NTTTTTKSEDGHYARTDYAENANKLEESAREHHIP CPEHYNGFCMHGKCEHSINMQEPSCRCDAGYTGQH CEKKDYSVLYVVPGPVRFQYVGGGSHHHHHH |
| TMEW20 (SEQ ID NO: 581) | spTMEFF2(230-320)-G3S-ratIgG1Fc | NTTTTTKSEDGHYARTDYAENANKLEESAREHHIP CPEHYNGFCMHGKCEHSINMQEPSCRCDAGYTGQH CEKKDYSVLYVVPGPVRFQYVGGGSPRNCGGDCKP CICTGSEVSSVFIFPPPKPKDVLTITLTPKVTCVVV DISQDDPEVHFSWFVDDVEVHTAQTRPPEEQFNST FRSVSELPILHQDWLNGRTFRCKVTSAAFPSPIEK TISKPEGRTQVPHVYTMSPTKEEMTQNEVSITCMV KGFYPPDIYVEWQMNGQPQENYKNTPPTMDTDGSY FLYSKLNVKKEKWQQGNTFTCSVLHEGLHNHHTEK SLSHSPGKGGGSHHHHHH |

7-2 Generation of Anti-TMEFF2 Antibodies

Antibody generation using transgenic rats expressing human immunoglobulin loci (OmniRat®) The OmniRat® contains a chimeric human/rat IgH locus (comprising 22 human $V_H$s, all human D and $J_H$ segments in natural configuration linked to the rat $C_H$ locus) together with fully human IgL loci (12 Vκs linked to Jκ-Cκ and 16 Vλs linked to Jλ-Cλ). (see e.g., Osborn, et al. (2013) J Immunol 190(4): 1481-1490). Accordingly, the rats exhibit reduced expression of rat immunoglobulin, and in response to immunization, the introduced human heavy and light chain transgenes undergo class switching and somatic mutation to generate high affinity chimeric human/rat IgG monoclonal antibodies with fully human variable regions. The preparation and use of OmniRat®, and the genomic modifications carried by such rats, is described in WO14/093908.

hybridomas and the hybridoma supernatants were screened for binding to human TMEFF2-FL-ECD-His-Avitag (TMEW1) protein by ELISA and/or SPARCL (Spatial Proximity Analyte Reagent Capture Luminescence). Several supernatants were selected for secondary ELISA and SPARCL screening of binding to TMEFF ECD, FS2-EGF, or EGF domain only TMEFF2. Based on the screening results, several hybridoma clones were sequenced, expressed and characterized for functionality.

Antibody Generation from Phage Display Libraries

TMEFF2 binding Fabs were selected using standard methods from two sets of de novo pIX phage display libraries as described in Shi et al., J Mol Biol 397:385-96, 2010 and WO2009/085462). Briefly, two sets of libraries, referred to as V3.0 and V5.0, were generated by diversifying human scaffolds where germline VH genes IGHV1-69*01, IGHV3-23*01 and IGHV5-51*01 were recombined with the human IGHJ-4 minigene via the H3 loop (IGHJ-6 minigene was also used in V5.0), and human germline VLkappa genes 012 (IGKV1-39*01), L6 (IGKV3-11*01), A27 (IGKV3-20*01), and B3 (IGKV4-1*01) were recombined with the IGKJ-1 minigene to assemble complete VH and VL domains. Positions in the heavy and light chain variable regions around the H1, H2, L1, L2 and L3 loops in frequent contact with protein and peptide antigens were chosen for diversification. Sequence diversity at selected positions was limited to residues occurring at each position in the IGHV or IGLV germline gene families of the respective IGHV or IGLV genes. Diversity at the H3 loop was generated by utilizing short to mid-sized synthetic loops of lengths 7-14 amino acids for V3.0 libraries, and lengths 6-19 amino acids for V5.0 libraries. The amino acid distribution at H3 was designed to mimic the observed variation of amino acids in human antibodies. The scaffolds utilized to generate libraries were named according to their human VH and VL germline gene origin. For both V3.0 and V5.0 sets, each of the three heavy chain libraries were combined with the four germline light chains or germline light chain libraries to generate 12 unique VH:VL combinations for each set of libraries which are used for selection experiments.

V Region Cloning

Total RNA from hybridoma cell lysates of phage were purified using RNeasy 96 kit (Qiagen) following the manufacturer's protocol. The resulting RNA was quantitated using Drop Sense and either stored at −80° C. or used for cDNA synthesis using Invitrogen SuperScript III First-Strand Synthesis System by RT-PCR (Invitrogen). The first strand cDNA synthesis was carried out using gene specific primers annealed to the constant regions of heavy, kappa, and lambda chains, respectively. The RT-PCR reaction mixture comprised of up to 3 µg of purified RNA, gene specific primer, dNTP mix, reaction buffer, 25 mM $MgCl_2$, DTT, RNaseOUT™ (40 U/µl, Invitrogen), and SuperScript™ III RT (200 U/µl, Invitrogen Cat #18080-051) was incubated at 50° C. for 50 minutes and 85° C. for 5 minutes. The resulting single-stranded cDNA was stored at −20° C., or used directly for PCR amplification. The PCR reaction was carried out using Platinum Pfx polymerase (Invitrogen). The v-region fragments were amplified by forward and reverse primers annealing to the leader sequences and constant regions of heavy, kappa and lambda chains, respectively, using optimized PCR conditions. The resulting PCR fragments were sequenced, the amino acid sequences of the recovered v-regions were codon optimized and cloned into the pUnder-based expression vector carrying the IgG4 constant region with S228P, F234A and L235A mutations (IgG4PAA isotype).

Expi293 Small Scale Transfection and Purification

Select antibodies identified from the immunization campaigns or phage display were cloned and expressed as IgG1PAA and purified via small 2 ml scale. Expi293™ cells (ThermoFisher Scientific) were seeded at $1.25 \times 10^5$-$2.25 \times 10^5$ viable cells/mL density in Expi293™ Expression Medium and cultured in 125 mL-2 L shake flasks at 37° C., 7% $CO_2$. Cells were sub-cultured when density reached the log phase growth at $3 \times 10^6$-$5 \times 10^6$ viable cells/mL with a 98-99% viability.

On day of transfection, the viable cell density and percent viability was determined. Cells were transfected at a density of 3×106 viable cells/mL following manufacturer's Transfection protocol (ThermoFisher Publication Number MAN0007814). Culture were harvested on Day 6 post-transfection by centrifugation at 850×G for 15 minutes before purification. Antibodies were purified from the clarified supernatants using mAb Select Sure resin (GE Healthcare) and dialyzed into PBS. Protein concentrations were determined by A280 measurement on the filtrate using a DropSense Instrument (Trinean).

7-3 Characterization of Anti-TMEFF2 Antibodies

Anti-TMEFF2 Antibodies Bind TMEFF2 with High Affinity

Binding of select IgG4PAA anti-TMEFF2 antibodies to TMEFF2 ECD (TMEW1: TMEFF2-FL ECD-His-Avitag) and/or the membrane proximal region (TMEW19: spTMEFF2(230-320)G3S-H6) was assessed using Proteon (TMEB674, TMEB675, TMEB 565 and TMEB570) or Biacore SPR (TMEB762 and TMEB757). The kinetic parameters of binding selected antibodies are show in Table 59. The anti-TMEFF2 antibodies were found to bind both the TMEFF2 ECD and TMEFF2 membrane proximal region with picomolar affinities.

TABLE 59

| Antibody | Antigen | TMEFF2 domain | ka (1/Ms) | kd (1/s) | KD (nM) |
|---|---|---|---|---|---|
| TMEB674 | TMEW1 | ECD | 2.01E+06 | 1.62E−04 | 0.10 |
| TMEB674 | TMEW19 | MP* | 8.37E+05 | 1.75E−04 | 0.20 |
| TMEB675 | TMEW1 | ECD | 2.65E+06 | 1.53E−04 | 0.10 |
| TMEB675 | TMEW19 | MP | 9.72E+05 | 1.58E−04 | 0.20 |
| TMEB565 | TMEW1 | ECD | 3.84E+05 | 9.13E−06 | 0.02 |
| TMEB565 | TMEW19 | MP | 7.77E+05 | 6.39E−06 | 0.01 |
| TMEB570 | TMEW1 | ECD | 4.64E+05 | 5.13E−05 | 0.11 |
| TMEB570 | TMEW19 | MP | 7.62E+05 | 4.67E−05 | 0.06 |
| TMEB762 | TMEW1 | ECD | 5.41E+05 | 1.74E−04 | 0.32 |
| TMEB757 | TMEW1 | ECD | 5.42E+05 | 1.67E−04 | 0.31 |

*MP: membrane proximal region

ProteOn SPR

The binding of anti-TMEFF2 mAbs to the ECD and the membrane proximal region of human TMEFF2 was measured by ProteOn SPR (Bio-Rad). The purified mAbs (diluted to a final concentration of 1 µg/ml in PBST) were used as ligands in the assay and were immobilized through Fc capture to Goat Anti-Human (GAH) IgG Fc. For amine coupling of the GAH IgG Fc, a 1:1 mixture of EDC (40 mM) and NHS (10 mM) were mixed immediately prior to injection to activate the chip surface and injected in the vertical orientation. GAH-Fc (at 30 µg/ml) antibody in acetate buffer (pH 5.0) was then flowed over the surface for 300 seconds at 30 µl/min in the vertical orientation. Any remaining reactive carboxyl groups in the surface were subsequently deactivated by injecting 1M Ethanolamine (pH 8.5) in the same orientation. The antibodies were used at a concentration of 1 µg/ml for immobilization. The antibodies were flowed over the surface in the horizontal direction. Human TMEFF2 ECD or the membrane proximal region in 3-fold dilution series of 5 concentrations (highest concentration ranging from 100-600 nM) was flowed in as analyte in the vertical orientation to bind to the captured molecules. A buffer sample was also injected in the $6^{th}$ channel in the vertical direction to monitor any drift in the baseline signal. The association and dissociation phases for all concentrations were monitored over 3 minutes and 30 (or 15) minutes respectively, at a flow rate of 100 µL/min. The binding surface was regenerated for the next interaction cycle using an 18 second pulse of 0.8% phosphoric acid to remove the bound antigen. The raw data were processed by subtracting two sets of reference data from the response data: 1) the inter-spot signals to correct for the non-specific interactions between the antigen and the empty chip surface; 2) the empty channel signals (where only PBST was flowed over the chip) to correct for non-specific baseline drift.

Biacore 8K SPR

The binding of anti-TMEFF2 mAbs to human TMEFF2 ECD was measured by Biacore 8K SPR. The format of the assay was to capture the mAbs using a high density anti-human Fc surface, then inject human TMEFF2 concentration titration using a single cycle kinetics method. Goat anti-human Fc IgG (Jackson Immunoresearch, Cat #109-005-098) was directly immobilized via amine coupling at 30 µg/mL in 10 mM acetate buffer, pH 4.5 on flow cells 1 and 2, on CM5 Sensor Chip (GE) with a flow rate of 30 µL/min in HBSP (GE) buffer. The mAbs were captured on the anti-human Fc IgG surface at 0.5 µg/ml (~200-300 RU) on flow cell 2. The running buffer was then changed to HBSP+ 100 ug/ml BSA. TMEFF2 ECD at 30 nM concentration in 3-fold dilution series was injected from low to high concentration using single cycle kinetics method. The off-rate was monitored 30 minutes after the last or highest concentration injection and then the surface was regenerated using 0.8% phosphoric acid (Bio-Rad). A buffer blank run, capturing the same mAbs and using the same conditions of sample run was also completed. The raw data were processed by subtracting two sets of reference data from the response data: 1) reference flow cell 1 subtracted from sample flow cell 2 and 2) buffer blank run from experimental run. The processed data at all concentrations for each mAb were globally fit to a 1:1 simple Langmuir binding model to extract estimates of the kinetic (kon, koff) and affinity (KD) constants.

Thermal Stability of Anti-TMEFF2 Antibodies

TMEB675 showed lower than usual thermal stability profile by DSC (Differential Scanning Calorimetry) with onset of unfolding Tm=52° C. and the first thermal transition (Tm1) at =60.4° C. A closer examination of the sequence of TMEB675 (see Example 4) showed the presence of Somatic HyperMutations (SHM) within the framework region of heavy and light chain. Several re-engineered variants were sub-cloned, expressed, purified and profiled by DSC. The resulting mAbs TMEB762 and TMEFB757 showed desirable thermal stability profile (Tm1=69.4° C. and Tm1=69.7° C. respectively). In comparison to TMEB675, TMEB762 had the following amino acid modifications in the heavy chain: R14P, P20L and H81Q, while TMEFB757 had the following amino acid modifications in the heavy chain: R14P and P20L. In comparison to TMEB675, TMEB762 had the following amino acid modifications in the light chain: A1D and A91P, while TMEFB757 had A91P modification in the light chain. Residue numbering is according to Kabat. The kinetic parameters of binding of TMEB675, TMEB762 to TMEFF2 ECD is shown in Table 59.

7-4 Structural Characterization of Anti-TMEFF2 Antibodies

The cDNA sequences and amino acid translations of the antibodies were obtained using standard techniques. After polypeptide sequence determination, some antibody cDNAs encoding the variable regions or full-length antibodies were codon optimized using standard methods for scale-up expression.

Table 60 shows the HCDR1 and the HCDR2 amino acid sequences of select anti-TMEFF2 antibodies.

Table 61 shows the HCDR3 amino acid sequences of select anti-TMEFF2 antibodies.

Table 62 shows the LCDR1 and the LCDR2 amino acid sequences of select anti-TMEFF2 antibodies.

Table 63 shows the LCDR3 amino acid sequences of select anti-TMEFF2 antibodies.

Table 64 shows the VH and the VL amino acid sequence of select anti-TMEFF2 antibodies.

Table 65 shows the SEQ ID NOs: of heavy and light chains of select anti-TMEFF2 antibodies.

Table 66 shows the heavy chain amino acid sequences of select anti-TMEFF2 antibodies.

Table 67 shows the light chain amino acid sequences of select anti-TMEFF2 antibodies.

Table 68 shows the SEQ ID NOs: of polynucleotides encoding various anti-TMEFF2 antibody chains.

TABLE 60

| mAb | HCDR1 sequence | HCDR1 SEQ ID NO: | HCDR2 sequence | HCDR2 SEQ ID NO: |
|---|---|---|---|---|
| TMEB675 | SYSMS | 582 | VISGSGGFTDYADSVKG | 584 |
| TMEB570 | SYYIS | 583 | GIIPISGRANYAQKFQG | 585 |
| TMEB674 | SYSMS | 582 | VISGGGSFTSYADSVKG | 586 |
| TMEB565 | SYYIS | 583 | GIIPISGRANYAQKFQG | 585 |
| TMEB762 | SYSMS | 582 | VISGSGGFTDYADSVKG | 584 |
| TMEB757 | SYSMS | 582 | VISGSGGFTDYADSVKG | 584 |

TABLE 61

| mAb | HCDR3 sequence | HCDR3 SEQ ID |
|---|---|---|
| TMEB675 | MPLNSPHDY | 587 |
| TMEB570 | DGYSSGRSTTYAFDY | 16 |
| TMEB674 | MPLNSPHDC | 17 |
| TMEB565 | DGYSSGRSTTYAFDY | 16 |
| TMEB762 | MPLNSPHDY | 587 |
| TMEB757 | MPLNSPHDY | 587 |

TABLE 62

| mAb | LCDR1 amino acid | LCDR1 SEQ ID NO: | LCDR2 amino acid | LCDR2 SEQ ID NO: |
|---|---|---|---|---|
| TMEB675 | RASQGIRNDLG | 18 | AASSLQS | 588 |
| TMEB570 | RASQSVSTYYLA | 19 | GASYRAT | 21 |
| TMEB674 | RASQGIRNDLG | 18 | AASSLQS | 588 |
| TMEB565 | RASQGIRNDLG | 18 | AASSLQS | 588 |
| TMEB762 | RASQGIRNDLG | 18 | AASSLQS | 588 |
| TMEB757 | RASQGIRNDLG | 18 | AASSLQS | 588 |

TABLE 63

| mAb | LCDR3 amino acid | LCDR3 SEQ ID NO: |
|---|---|---|
| TMEB675 | LQDYNYALT | 22 |
| TMEB570 | QQYGHSPIT | 23 |
| TMEB674 | LQDYNYSLT | 24 |

TABLE 63-continued

| mAb | LCDR3 amino acid | LCDR3 SEQ ID NO: |
|---|---|---|
| TMEB565 | LQDYNYALT | 22 |
| TMEB762 | LQDYNYPLT | 603 |
| TMEB757 | LQDYNYPLT | 603 |

TABLE 64

| Antibody | VH name | VH amino acid sequence | VH SEQ ID NO: | VL name | VL amino acid sequence | VL SEQ ID NO: |
|---|---|---|---|---|---|---|
| TMEB675 | TMEH411 | EVQLLESGGGLVQRGGSLRPSCAASGFTFSSYSMSWVRQAPGKGLEWVSVISGSGGFTDYADSVKGRFTISRDNSKNTLYLHMNSLRAEDTAVYYCARMPLNSPHDYWGQGTLVTVSS | 25 | TM3L127 | AIQMTQSPSSLSASVGDRVTITCRASQGIRNDLGWYQQKPGKAPKLLIYAASSLQSGVPSRFSGSGSGTDFTLTISSLQPEDFATYYCLQDYNYALTFGGGTKVEIK | 28 |
| TMEB570 | TMEH396 | QVQLVQSGAEVKKPGSSVKVSCKASGGTFSSYYISWVRQAPGQGLEWMGGIIPISGRANYAQKFQGRVTITADESTSTAYMELSSLRSEDTAVYYCARDGYSSGRSTTYAFDYWGQGTLVTVSS | 589 | TMEL112 | EIVLTQSPGTLSLSPGERATLSCRASQSVSTYYLAWYQQKPGQAPRLLIYGASYRATGIPDRFSGSGSGTDFTLTISRLEPEDFAVYYCQQYGHSPITFGQGTKVEIK | 29 |
| TMEB674 | TMEH410 | EVQLLESGGLVQPPGGSLRLSCAASGFTFSSYSMSWVRQAPGKGLEWVSVISGGGSFTSYADSVKGRFTISRDNSNNTLYLQMSSLRAEDTAFYYCARMPLNSPHDCWGQGTLVTVSS | 27 | TMEL126 | AIQMTQSPSSLSASVGDRVTITCRASQGIRNDLGWYQQKPGKAPKLLIYAASSLQSGVPSRFSGSGSGTDFTLTISSLQPEDFATYYCLQDYNYSLTFGGGTKVEIR | 30 |
| TMEB565 | TMEH396 | QVQLVQSGAEVKKPGSSVKVSCKASGGTFSSYYISWVRQAPGQGLEWMGGIIPISGRANYAQKFQGRVTITADESTSTAYMELSSLRSEDTAVYYCARDGYSSGRSTTYAFDYWGQGTLVTVSS | 589 | TMEL111 | EIVLTQSPGTLSLSPGERATLSCRASQSVATYYLAWYQQKPGQAPRLLIYGASSRATGIPDRFSGSGSGTDFTLTISRLEPEDFAVYYCQQYGYNPITFGQGTKVEIK | 31 |
| TMEB762 | TMEH459 | EVQLLESGGGLVQPGGSLRLSCAASGFTFSSYSMSWVRQAPGKGLEWVSVISGSGGFTDYADSVKGRFTISRDNSKNTLYLQMNSLRAEDTAVYYCARMPLNSPHDYWGQGTLVTVSS | 604 | DL3L129 | DIQMTQSPSSLSASVGDRVTITCRASQGIRNDLGWYQQKPGKAPKLLIYAASSLQSGVPSRFSGSGSGTDFTLTISSLQPEDFATYYCLQDYNYPLTFGGGTKEVIK | 607 |
| TMEB757 | TMEH460 | EVQLLESGGGLVQPGGSLRLSCAASGFTFSSYSMSWVRQAPGKGLEWVSVISGSGGFTDYADSVKGRFTISRDNSKNTLYLHMNSLRAEDTAVYYCARMPLNSPHDYWGQGTLVTVSS | 612 | B76L85 | AIQMTQSPSSLSASVGDRVTITCRASQGIRNDLGWYQQKPGKAPKLLIYAASSLQSGVPSRFSGSGSGTDFTLTISSLQPEDFATYYCLQDYNYPLTFGGGTKVEIK | 613 |

TABLE 65

| Antibody | VH name | VL name | HC protein SEQ ID NO: | LC protein SEQ ID NO: |
|---|---|---|---|---|
| TMEB675 | TMEH411 | TMEL127 | 32 | 35 |
| TMEB570 | TMEH396 | TMEL112 | 33 | 36 |
| TMEB674 | TMEH410 | TMEL126 | 34 | 37 |
| TMEB565 | TMEH396 | TMEL111 | 33 | 38 |
| TMEB762 | TMEH459 | DL3L129 | 614 | 615 |
| TMEB757 | TMEH460 | B76L85 | 616 | 617 |

TABLE 66

| HC protein SEQ ID NO: | HC amino acid sequence |
|---|---|
| 32 (TMEB675 HC) | evqllesggglvqrggslrpscaasgftfssysmswvrqapgkglewvsvisgsggftdyadsvkgrftisrdnskntlylhmnslraedtavyycarmplnsphdywgqgtlvtvssastkgpsvfplapcsrstsestaalgclvkdyfpepvtvswnsgaltsgvhtfpavlqssglyslssvvtvpsssslgtktytcnvdhkpsntkvdkrveskygppcppcpapeaaggpsvflfppkpkdtlmisrtpevtcvvvdvsqedpevqfnwyvdgvevhnaktkpreeqfnstyrvvsyltvlhqdwlngkeykckvsnkglpssiektiskakgqprepqvytlppsqeemtknqvsltclvkgfypsdiavewesngqpennykttppvldsdgsfflysrltvdksrwqegnvfscsvmhealhnhytqkslslslgk |

TABLE 66-continued

| HC protein SEQ ID NO: | HC amino acid sequence |
|---|---|
| 33 (TMEB570, TMEB565 HC) | qvqlvqsgaevkkpgssvkvsckasggtfssyyisw vrqapgqglewmggiipisgranyaqkfqgrvtita deststaymelsslrsedtavyycardgyssgrstt yafdywgqgtlvtvssastkgpsvfplapcsrstse staalgclvkdyfpepvtvswnsgaltsgvhtfpav lqssglyslssvvtvpssslgtktytcnvdhkpsnt kvdkrveskygppcppcpapeaaggpsvflfppkpk dtlmisrtpevtcvvvdvsqedpevqfnwyvdgvev hnakttkpreeqfnstyrvvsyltvlhqdwlngkeyk ckvsnkglpssiektiskakgqprepqvytlppsqe emtknqvsltclvkgfypsdiavewesngqpennyk ttppvldsdgsfflysrltvdksrwqegnvfscsvm healhnhytqkslslslgk |
| 34 (TMEB674 HC) | evqllesggglvqppggslrlscaasgftfssysms wvrqapgkglewvsvisgggsftsyadsvkgrftis rdnsnntlylqmsslraedtafyycarmplnsphdc wgqgtlvtvssastkgpsvfplapcsrstsestaal gclvkdyfpepvtvswnsgaltsgvhtfpavlqssg lyslssvvtvpssslgtktytcnvdhkpsntkvdkr veskygppcppcpapeaaggpsvflfppkpkdtlmi srtpevtcvvvdvsqedpevqfnwyvdgvevhnakt kpreeqfnstyrvvsyltvlhqdwlngkeykckvsn kglpssiektiskakgqprepqvytlppsqeemtkn qvsltclvkgfypsdiavewesngqpennykttppv ldsdgsfflysrltvdksrwqegnvfscsvmhealh nhytqkslslslgk |
| 614 (TMEB762 HC) | evqllesggglvqpggslrlscaasgftfssysmsw vrqapgkglewvsvisgsgggftdyadsvkgrftisr dnskntlylqmnslraedtavyycarmplnsphdyw gqgtlvtvssastkgpsvfplapcsrstsestaalg clvkdyfpepvtvswnsgaltsgvhtfpavlqssgl yslssvvtvpssslgtktytcnvdhkpsntkvdkrv eskygppcppcpapeaaggpsvflfppkpkdtlmis rtpevtcvvvdvsqedpevqfnwyvdgvevhnaktk preeqfnstyrvvsyltvlhqdwlngkeykckvsnk glpssiektiskakgqprepqvytlppsqeemtknq vsltclvkgfypsdiavewesngqpennykttppvl dsdgsfflysrltvdksrwqegnvfscsvmhealhn hytqkslslslgk |
| 616 (TMEB757 HC) | evqllesggglvqpggslrlscaasgftfssysmsw vrqapgkglewvsvisgsgggftdyadsvkgrftisr dnskntlylhmnslraedtavyycarmplnsphdyw gqgtlvtvssastkgpsvfplapcsrstsestaalg clvkdyfpepvtvswnsgaltsgvhtfpavlqssgl yslssvvtvpssslgtktytcnvdhkpsntkvdkrv eskygppcppcpapeaaggpsvflfppkpkdtlmis rtpevtcvvvdvsqedpevqfnwyvdgvevhnaktk preeqfnstyrvvsyltvlhqdwlngkeykckvsnk glpssiektiskakgqprepqvytlppsqeemtknq vsltclvkgfypsdiavewesngqpennykttppvl dsdgsfflysrltvdksrwqegnvfscsvmhealhn hytqkslslslgk |

TABLE 67

| LC protien SEQ ID NO: | LC amino acid sequence |
|---|---|
| 35 (TMEB675 LC) | aiqmtqspsslsasvgdrvtitcrasqgirndlgwyq qkpgkapklliyaasslqsgvpsrfsgsgsgtdftlt isslqpedfatyyclqdynyaltfgggtkveikrtva apsvfifppsdeqlksgtasvvcllnnfypreakvqw kvdnalqsgnsqesvteqdskdstyslsstltlskad yekhkvyacevthqglsspvtksfnrgec |
| 36 (TMEB570 LC) | eivltqspgtlslspgeratlscrasqsvstyylawy qqkpgqpaprlliygasyratgipdrfsgsgsgtdft ltisrlepedfavyycqqyghspitfgqgtkveikrt vaapsvfifppsdeqlksgtasvvcllnnfypreakv qwkvdnalqsgnsqesvteqdskdstyslsstltlsk adyekhkvyacevthqglsspvtksfnrgec |
| 37 (TMEB674 LC) | aiqmtqspsslsasvgdrvtitcrasqgirndlgwyq qkpgkapklliyaallsqsgvpsrfsgsgsgtdftlt isslqpedfatyyclqdynysltfgggtkveirrtva apsvfifppsdeqlksgtasvvcllnnfypreakvqw kvdnalqsgnsqesvteqdskdstyslsstltlskad yekhkvyacevthqglsspvtksfnrgec |
| 38 (TMEB565 LC) | eivltqspgtlslspgeratlscrasqsvatyylawy qqkpgqpaprlliygassratgipdrfsgsgsgtdftl tisrlepedfavyycqqygynpitfgqgtkveikrtv aapsvfifppsdeqlksgtasvvcllnnfypreakvq wkvdnalqsgnsqesvteqdskdstyslsstltlska dyekhkvyacevthqglsspvtksfnrgec |
| 615 (TMEB762 LC) | diqmtqspsslsasvgdrvtitcrasqgirndlgwyq qkpgkapklliyaasslqsgvpsrfsgsgsgtdftlt isslqpedfatyyclqdynypltfgggtkveikrtva apsvfifppsdeqlksgtasvvcllnnfypreakvqw vdnalqsgnsqesvteqdskdstyslsstltlskady ekhkvyacevthqglsspvtksfnrgec |
| 617 (TMEB757 LC) | aikmtqspsslsasvgdrvtitcrasqgirndlgwyq qkpgkapklliyaasslqsgvpsrfsgsgsgtdftlt isslqpedfatyyclqdynypltfgggtkveikrtva apsvfifppsdeqlksgtasvvcllnnfypreakvqw kvdnalqsgnsqesvteqdskdstyslsstltlskad yekhkvyacevthqglsspvtksfnrgec |

TABLE 68

| Antibody | VH cDNA SEQ ID NO: | VL cDNA SEQ ID NO: | HC cDNA SEQ ID NO: | LC cDNA SEQ ID NO: |
|---|---|---|---|---|
| TMEB675 | 39 | 42 | 46 | 49 |
| TMEB570 | 40 | 43 | 47 | 50 |
| TMEB674 | 41 | 44 | 48 | 51 |
| TMEB565 | 40 | 45 | 47 | 590 |
| TMEB762 | 618 | 619 | 620 | 621 |
| TMEB757 | 622 | 623 | 624 | 625 |

(TMEB675 VH cDNA)

SEQ ID NO: 39

Gaggtgcagctgctggaaagaggcggaggcctggtgcagagaggaggaagcctgagacccagctgtgccgccagcggcttcaccttc agcagctacagcatgagctgggtcaggcaggcccctggcaaaggactggagtgggtgagcgtgattagcggcagcggcggcttcacc gattacgccgacagcgtgaagggcaggttcaccatcagcagggacaatagcaagaacaccctgtacctgcacatgaacagcctgagg gccgaggacaccgccgtgtactactgcgccaggatgcccctgaacagccctcacgactactggggccagggaaccctggtgaccgtg tccagc -continued (TMEB570, TMEB565 VH cDNA)

SEQ ID NO: 40

Caggtgcagctggtgcagagcggcgcggaagtgaaaaaaccgggcagcagcgtgaaagtgagctgcaaagcgagcggcggcaccttc
agctcctattacattagctgggtgcgccaggcgccgggccagggcctggaatggatgggtggcattatcccaatcagtgggcgtgct
aattatgcgcagaaatttcagggccgcgtgaccattaccgctgatgaaagcaccagcaccgcgtatatggaactgagcagcctgcgc
agcgaagataccgcggtgtattattgcgcgcgcgacggctacagtagtggacgtagcacaacatacgcatttgactattggggccag
ggcaccctggtgaccgtgtcgagt (TMEB674 VH cDNA)

SEQ ID NO: 41

Gaagtgcagctgctggagagcggaggaggactggtgcagcctcctggcggaagcctgagactgagctgcgccgctagcggcttcacc
ttcagcagctacagcatgagctgggtgagacaggctcctggcaagggcctggagtgggtgagcgtgatcagcggcggaggcagcttt
accagctacgccgacagcgtgaagggcaggttcaccatcagcagggacaacagcaacaaccccctgtacctgcagatgagcagcctg
agggccgaggacaccgccttctactactgcgccaggatgcccctgaacagccccatgactgctggggacagggcaccctggtgacc
gtgagcagc (TMEB675 VL cDNA)

SEQ ID NO: 42

Gccatccagatgacccagagccctagcagcctgagcgctagcgtgggcgacagggtgaccatcacctgcagggccagccagggcatc
agaaacgacctgggctggtaccagcagaagcccggcaaggccccccaagctgctgatctacgccgccagcagcctgcagagcggagtg
cctagcaggttcagcggaagcggcagcggcaccgacttcaccctgaccatcagcagcctgcagcccgaggacttcgccacctactac
tgcctgcaggactacaactacgccctgacattcggcggcggcaccaaggtggagatcaag (TMEB570 VL cDNA)

SEQ ID NO: 43

Gaaattgtgctgacccagagcccgggcaccctgagcctgagcccgggcgaacgcgcgaccctgagctgccgcgcgagccagagcgtt
tccacatactacctggcgtggtatcagcagaaaccgggccaggcgccgcgcctgctgatttacggtgcctcctatcgcgcgaccggc
attccggatcgctttagcggcagcggttccggcaccgattttaccctgaccattagccgcctggaaccggaagattttgcggtgtat
tattgccagcagtacggtcacagcccgattacttttggccagggcaccaaagtggaaatcaaa (TMEB674 VL cDNA)

SEQ ID NO: 44

Gccatccagatgacccagagccctagcagcctgagcgctagcgtgggcgacagggtgaccatcacctgcagggccagccagggcatc
aggaacgacctgggctggtaccagcagaagcccggcaaggccccccaagctgctgatctacgccgccagcagcctgcagagcggagtg
cctagcaggttcagcggcagcggaagcggcaccgacttcaccctgaccatctccagcctgcagcccgaggacttcgccacctactac
tgcctgcaggactacaactacagcctgaccttcggcggcggcaccaaggtggagatcagg (TMEB565 VL cDNA)

SEQ ID NO: 45

Gaaattgtgctgacccagagcccgggcaccctgagcctgagcccgggcgaacgcgcgaccctgagctgccgcgcgagccagagcgtt
gccacctattatcttgcgtggtatcagcagaaaccgggccaggcgccgcgcctgctgatttacggtgcatcctcccgtgcgaccggc
attccggatcgctttagcggcagcggttccggcaccgattttaccctgaccattagccgcctggaaccggaagattttgcggtgtat
tattgccagcagtacggctataacccaattacctttggccagggcaccaaagtggaaatcaaa (TMEB675 HC cDNA)

SEQ ID NO: 46 gaggtgcagctgctggaaagcggcggaggcctggtgcagagaggaggaagcctgagacccagctgtgccgccagcggcttcaccttc
agcagctacagcatgagctgggtcaggcaggcccctggcaaaggactggagtgggtgagcgtgattagcggcagcggcggcttcacc
gattacgccgacagcgtgaagggcaggttcaccatcagcagggacaatagcaagaacaccctgtacctgcacatgaacagcctgagg
gccgaggacaccgccgtgtactactgcgccaggatgcccctgaacagccctcacgactactggggccagggaaccctggtgaccgtg
tccagcgcttccaccaagggcccatccgtcttccccctggcgccctgctccaggagcacctccgagagcacagccgccctgggctgc
ctggtcaaggactacttccccgaaccggtgacggtgtcgtggaactcaggcgccctgaccagcggcgtgcacaccttcccggctgtc
ctacagtcctcaggactctactccctcagcagcgtggtgaccgtgccctccagcagcttgggcacgaaaacctacacctgcaacgta
gatcacaagcccagcaacaccaaggtggacaagagagttgagtccaaatatggtcccccatgcccaccatgcccagcacctgaggcc -continued gccggggaccatcagtcttcctgttcccccaaaacccaaggacactctcatgatctcccggacccctgaggtcacgtgcgtggtg gtggacgtgagccaggaagaccccgaggtccagttcaactggtacgtggatggcgtggaggtgcataatgccaagacaaagccgcgg gaggagcagttcaacagcacgtaccgtgtggtcagcgtcctcaccgtcctgcaccaggactggctgaacggcaaggagtacaagtgc aaggtctccaacaaaggcctcccgtcctccatcgagaaaaccatctccaaagccaaagggcagccccgagagccacaggtgtacacc ctgcccccatcccaggaggagatgaccaagaaccaggtcagcctgacctgcctggtcaaaggcttctaccccagcgacatcgccgtg gagtgggagagcaatgggcagccggagaacaactacaagaccacgcctcccgtgctggactccgacggctccttcttcctctacagc aggctaaccgtggacaagagcaggtggcaggaggggaatgtcttctcatgctccgtgatgcatgaggctctgcacaaccactacaca cagaagagcctctccctgtctctgggtaaa (TMEB570, TMEB565 HC cDNA)
SEQ ID NO: 47 caggtgcagctggtgcagagcggcgcggaagtgaaaaaacccgggcagcagcgtgaaagtgagctgcaaagcgagcggcggcaccttc agctcctattacattagctgggtgcgccaggcgccgggccagggcctggaatggatgggtggcattatcccaatcagtgggcgtgct aattatgcgcagaaatttcagggccgcgtgaccattaccgctgatgaaagcaccagcaccgcgtatatggaactgagcagcctgcgc agcgaagataccgcggtgtattattgcgcgcgcgacgctacagtagtggacgtagcacaacatacgcatttgactattggggccag ggcaccctggtgaccgtgtcgagtgcttccaccaagggcccatccgtcttccccctggcgccctgctccaggagcacctccgagagc acagccgccctgggctgcctggtcaaggactacttccccgaaccggtgacggtgtcgtggaactcaggcgccctgaccagcggcgtg cacaccttcccggctgtcctacagtcctcaggactctactccctcagcagcgtggtgaccgtgccctccagcagcttgggcacgaaa acctacacctgcaacgtagatcacaagcccagcaacaccaaggtggacaagagagttgagtccaaatatggtcccccatgcccacca tgcccagcacctgaggccgccggggggaccatcagtcttcctgttccccccaaaacccaaggacactctcatgatctcccggacccct gaggtcacgtgcgtggtggtggacgtgagccaggaagaccccgaggtccagttcaactggtacgtggatggcgtggaggtgcataat gccaagacaaagccgcgggaggagcagttcaacagcacgtaccgtgtggtcagcgtcctcaccgtcctgcaccaggactggctgaac ggcaaggagtacaagtgcaaggtctccaacaaaggcctcccgtcctccatcgagaaaaccatctccaaagccaaagggcagcccga gagccacaggtgtacaccctgcccccatcccaggaggagatgaccaagaaccaggtcagcctgacctgcctggtcaaaggcttctac cccagcgacatcgccgtggagtgggagagcaatgggcagccggagaacaactacaagaccacgcctcccgtgctggactccgacggc tccttcttcctctacagcaggctaaccgtggacaagagcaggtggcaggaggggaatgtcttctcatgctccgtgatgcatgaggct ctgcacaaccactacacacagaagagcctctccctgtctctgggtaaa (TMEB674 HC cDNA)
SEQ ID NO: 48 gaagtgcagctgctggagagcggaggaggactggtgcagcctcctggcggaagcctgagactgagctgcgccgctagcggatcacct tcagcagctacagcatgagctgggtgagacaggctcctggcaagggcctggagtgggtgagcgtgatcagcggcggaggcagattac cagctacgccgacagcgtgaagggcaggttcaccatcagcagggacaacagcaacaacaccctgtacctgcagatgagcagcctgag ggccgaggacaccgccttctactactgcgccaggatgcccctgaacagcccccatgactgctggggacagggcaccctggtgaccgt gagcagcgcttccaccaagggcccatccgtcttccccctggcgccctgctccaggagcacctccgagagcacagccgccctgggctg cctggtcaaggactacttccccgaaccggtgacggtgtcgtggaactcaggcgccctgaccagcggcgtgcacaccttcccggctgt cctacagtcctcaggactctactccctcagcagcgtggtgaccgtgccctccagcagcttgggcacgaaaacctacacctgcaacgt agatcacaagcccagcaacaccaaggtggacaagagagttgagtccaaatatggtcccccatgcccaccatgcccagcacctgaggc cgccggggggaccatcagtcttcctgttccccccaaaacccaaggacactctcatgatctcccggacccctgaggtcacgtgcgtggt ggtggacgtgagccaggaagaccccgaggtccagttcaactggtacgtggatggcgtggaggtgcataatgccaagacaaagccgcg ggaggagcagttcaacagcacgtaccgtgtggtcagcgtcctcaccgtcctgcaccaggactggctgaacggcaaggagtacaagtg caaggtctccaacaaaggcctcccgtcctccatcgagaaaaccatctccaaagccaaagggcagccccgagagccacaggtgtacac cctgcccccatcccaggaggagatgaccaagaaccaggtcagcctgacctgcctggtcaaaggcttctaccccagcgacatcgccgt ggagtgggagagcaatgggcagccggagaacaactacaagaccacgcctcccgtgctggactccgacggctccttcttcctctacag -continued caggctaaccgtggacaagagcaggtggcaggaggggaatgtcttctcatgctccgtgatgcatgaggctctgcacaaccactacac acagaagagcctctccctgtctctgggtaaa (TMEB675 LC cDNA)

SEQ ID NO: 49

Gccatccagatgacccagagccctagcagcctgagcgctagcgtgggcgacagggtgaccatcacctgcagggccagccagggcatc agaaacgacctgggctggtaccagcagaagcccggcaaggcccccaagctgctgatctacgccgccagcagcctgcagagcggagtg cctagcaggttcagcggaagcggcagcggcaccgacttcaccctgaccatcagcagcctgcagcccgaggacttcgccacctactac tgcctgcaggactacaactacgccctgacattcggcggcggcaccaaggtggagatcaagcgtacggtggctgcaccatctgtcttc atcttcccgccatctgatgagcagttgaaatctggaactgcctctgttgtgtgcctgctgaataacttctatcccagagaggccaaa gtacagtggaaggtggataacgccctccaatcgggtaactcccaggagagtgtcacagagcaggacagcaaggacagcacctacagc ctcagcagcaccctgacgctgagcaaagcagactacgagaaacacaaagtctacgcctgcgaagtcacccatcagggcctgagctcg cccgtcacaaagagcttcaacaggggagagtgt (TMEB570 LC cDNA)

SEQ ID NO: 50

Gaaattgtgctgacccagagcccgggcaccctgagcctgagcccgggcgaacgcgcgaccctgagctgccgcgcgagccagagcgtt tccacatactacctggcgtggtatcagcagaaaccgggccaggcgccgcgcctgctgatttacggtgcctcctatcgcgcgaccggc attccggatcgctttagcggcagcggttccggcaccgattttaccctgaccattagccgcctggaaccggaagattttgcggtgtat tattgccagcagtacggtcacagcccgattacttttggccagggcaccaaagtggaaatcaaacgtacggtggctgcaccatctgtc ttcatcttcccgccatctgatgagcagttgaaatctggaactgcctctgttgtgtgcctgctgaataacttctatcccagagaggcc aaagtacagtggaaggtggataacgccctccaatcgggtaactcccaggagagtgtcacagagcaggacagcaaggacagcacctac agcctcagcagcaccctgacgctgagcaaagcagactacgagaaacacaaagtctacgcctgcgaagtcacccatcagggcctgagc tcgcccgtcacaaagagcttcaacaggggagagtgt (TMEB674 LC cDNA)

SEQ ID NO: 51

Gccatccagatgacccagagccctagcagcctgagcgctagcgtgggcgacagggtgaccatcacctgcagggccagccagggcatc aggaacgacctgggctggtaccagcagaagcccggcaaggcccccaagctgctgatctacgccgccagcagcctgcagagcggagtg cctagcaggttcagcggcagcggaagcggcaccgacttcaccctgaccatctccagcctgcagcccgaggacttcgccacctactac tgcctgcaggactacaactacagcctgaccttcggcggcggcaccaaggtggagatcaggcgtacggtggctgcaccatctgtcttc atcttcccgccatctgatgagcagttgaaatctggaactgcctctgttgtgtgcctgctgaataacttctatcccagagaggccaaa gtacagtggaaggtggataacgccctccaatcgggtaactcccaggagagtgtcacagagcaggacagcaaggacagcacctacagc ctcagcagcaccctgacgctgagcaaagcagactacgagaaacacaaagtctacgcctgcgaagtcacccatcagggcctgagctcg cccgtcacaaagagcttcaacaggggagagtgt (TMEB565 LC cDNA)

SEQ ID NO: 590

Gaaattgtgctgacccagagcccgggcaccctgagcctgagcccgggcgaacgcgcgaccctgagctgccgcgcgagccagagcgtt gccacctattatcttgcgtggtatcagcagaaaccgggccaggcgccgcgcctgctgatttacggtgcatcctcccgtgcgaccggc attccggatcgctttagcggcagcggttccggcaccgattttaccctgaccattagccgcctggaaccggaagattttgcggtgtat tattgccagcagtacggctataacccaattacctttggccagggcaccaaagtggaaatcaaacgtacggtggctgcaccatctgtc ttcatcttcccgccatctgatgagcagttgaaatctggaactgcctctgttgtgtgcctgctgaataacttctatcccagagaggcc aaagtacagtggaaggtggataacgccctccaatcgggtaactcccaggagagtgtcacagagcaggacagcaaggacagcacctac agcctcagcagcaccctgacgctgagcaaagcagactacgagaaacacaaagtctacgcctgcgaagtcacccatcagggcctgagc tcgcccgtcacaaagagcttcaacaggggagagtgt (TMEB762 VH cDNA)

SEQ ID NO: 618 gaggtgcagctgctggaaagcggcggaggcctggtgcagcccggaggaagcctgagactcagctgtgccgccagcggcttcaccttc agcagctacagcatgagctgggtcaggcaggcccctggcaaaggactggagtgggtgagcgtgattagcggcagcggcggcttcacc (TMEB762 VL cDNA)

SEQ ID NO: 619 gacatccagatgacccagagccctagcagcctgagcgctagcgtgggcgacagggtgaccatcacctgcagggccagccagggcatc agaaacgacctgggctggtaccagcagaagcccggcaaggcccccaagctgctgatctacgccgccagcagcctgcagagcggagtg cctagcaggttcagcggaagcggcagcggcaccgacttcaccctgaccatcagcagcctgcagcccgaggacttcgccacctactac tgcctgcaggactacaactacccctgacattcggcggcggcaccaaggtggagatcaag (TMEB762 HC cDNA)

SEQ ID NO: 620 gaggtgcagctgctggaaagcggcggaggcctggtgcagcccggaggaagcctgagactcagctgtgccgccagcggcttcaccttc agcagctacagcatgagctgggtcaggcaggcccctggcaaaggactggagtgggtgagcgtgattagcggcagcggcggcttcacc gattacgccgacagcgtgaagggcaggttcaccatcagcagggacaatagcaagaacaccctgtacctgcagatgaacagcctgagg gccgaggacaccgccgtgtactactgcgccaggatgcccctgaacagccctcacgactactggggccagggaaccctggtgaccgtg tccagcgcttccaccaagggcccatccgtcttccccctggcgccctgctccaggagcacctccgagagcacagccgccctgggctgc ctggtcaaggactacttccccgaaccggtgacggtgtcgtggaactcaggcgccctgaccagcggcgtgcacaccttcccggctgtc ctacagtcctcaggactctactccctcagcagcgtggtgaccgtgccctccagcagcttgggcacgaaaacctacacttgcaacgta gatcacaagcccagcaacaccaaggtggacaagagagttgagtccaaatatggtcccccatgcccaccatgcccagcacctgaggcc gccggggaccatcagtcttcctgttccccccaaaacccaaggacactctcatgatctcccggacccctgaggtcacgtgcgtggtg gtggacgtgagccaggaagaccccgaggtccagttcaactggtacgtggatggcgtggaggtgcataatgccaagacaaagccgcgg gaggagcagttcaacagcacgtaccgtgtggtcagcgtcctcaccgtcctgcaccaggactggctgaacggcaaggagtacaagtgc aaggtctccaacaaaggcctcccgtcctccatcgagaaaaccatctccaaagccaaagggcagccccgagagccacaggtgtacacc ctgcccccatcccaggaggagatgaccaagaaccaggtcagcctgacctgcctggtcaaaggcttctaccccagcgacatcgccgtg gagtgggagagcaatgggcagccggagaacaactacaagaccacgcctcccgtgctggactccgacggctccttcttcctctacagc aggctaaccgtggacaagagcagatggcaggaggggaatgtcttctcatgctccgtgatgcatgaggctctgcacaaccactacaca cagaagagcctctccctgtctctgggtaaa (TMEB762 LC cDNA)

SEQ ID NO: 621 gacatccagatgacccagagccctagcagcctgagcgctagcgtgggcgacagggtgaccatcacctgcagggccagccagggcatc agaaacgacctgggctggtaccagcagaagcccggcaaggcccccaagctgctgatctacgccgccagcagcctgcagagcggagtg cctagcaggttcagcggaagcggcagcggcaccgacttcaccctgaccatcagcagcctgcagcccgaggacttcgccacctactac tgcctgcaggactacaactacccctgacattcggcggcggcaccaaggtggagatcaagcgtacggtggctgcaccatctgtcttc atcttcccgccatctgatgagcagttgaaatctggaactgcctctgttgtgtgcctgctgaataacttctatcccagagaggccaaa gtacagtggaaggtggataacgcccttccaatcgggtaactcccaggagagtgtcacagagcaggacagcaaggacagcacctacagc ctcagcagcaccctgacgctgagcaaagcagactacgagaaacacaaagtctacgcctgcgaagtcacccatcagggcctgagctcg cccgtcacaaagagcttcaacaggggagagtgttag (TMEB757 VH cDNA)

SEQ ID NO: 622 gaggtgcagctgctggaaagcggcggaggcctggtgcagcccggaggaagcctgagactcagctgtgccgccagcggcttcaccttc agcagctacagcatgagctgggtcaggcaggcccctggcaaaggactggagtgggtgagcgtgattagcggcagcggcggcttcacc gattacgccgacagcgtgaagggcaggttcaccatcagcagggacaatagcaagaacaccctgtacctgcacatgaacagcctgagg gccgaggacaccgccgtgtactactgcgccaggatgcccctgaacagccctcacgactactggggccagggaaccctggtgaccgtg tccagc -continued (TMEB757 VL cDNA)
SEQ ID NO: 623
gccatccagatgacccagagccctagcagcctgagcgctagcgtgggcgacaggtgaccatcacctgcagggccagccagggcatc agaaacgacctgggctggtaccagcagaagcccggcaaggccccaagctgctgatctacgccgccagcagcctgcagagcggagtg cctagcaggttcagcggaagcggcagcggcaccgacttcaccctgaccatcagcagcctgcagcccgaggacttcgccacctactac tgcctgcaggactacaactaccccctgacattcggcggcggcaccaaggtggagatcaag (TMEB757 HC cDNA)
SEQ ID NO: 624
gaggtgcagctgctggaaagcggcggaggcctggtgcagcccggaggaagcctgagactcagctgtgccgccagcggcttcaccttc agcagctacagcatgagctgggtcaggcaggcccctggcaaaggactggagtgggtgagcgtgattagcggcagcggcggcttcacc gattacgccgacagcgtgaagggcaggttcaccatcagcagggacaatagcaagaacaccctgtacctgcacatgaacagcctgagg gccgaggacaccgccgtgtactactgcgccaggatgcccctgaacagccctcacgactactggggccagggaaccctggtgaccgtg tccagcgcttccaccaagggcccatccgtcttccccctggcgccctgctccaggagcacctccgagagcacagccgccctgggctgc ctggtcaaggactacttccccgaaccggtgacggtgtcgtggaactcaggcgccctgaccagcggcgtgcacaccttcccggctgtc ctacagtcctcaggactctactccctcagcagcgtggtgaccgtgccctccagcagcttgggcacgaaaacctacacttgcaacgta gatcacaagcccagcaacaccaaggtggacaagagagttgagtccaaatatggtcccccatgcccaccatgcccagcacctgaggcc gccggggaccatcagtcttcctgttccccccaaaacccaaggacactctcatgatctcccggacccctgaggtcacgtgcgtggtg gtggacgtgagccaggaagaccccgaggtccagttcaactggtacgtggatggcgtggaggtgcataatgccaagacaaagccgcgg gaggagcagttcaacagcacgtaccgtgtggtcagcgtcctcaccgtcctgcaccaggactggctgaacggcaaggagtacaagtgc aaggtctccaacaaaggcctcccgtcctccatcgagaaaaccatctccaaagccaaagggcagccccgagagccacaggtgtacacc ctgcccccatcccaggaggagatgaccaagaaccaggtcagcctgacctgcctggtcaaaggcttctaccccagcgacatcgccgtg gagtgggagagcaatgggcagccggagaacaactacaagaccacgcctcccgtgctggactccgacggctccttcttcctctacagc aggctaaccgtggacaagagcagatggcaggaggggaatgtcttctcatgctccgtgatgcatgaggctctgcacaaccactacaca cagaagagcctctccctgtctctgggtaaa (TMEB757 LC cDNA)
SEQ ID NO: 625
gccatccagatgacccagagccctagcagcctgagcgctagcgtgggcgacaggtgaccatcacctgcagggccagccagggcatc agaaacgacctgggctggtaccagcagaagcccggcaaggccccaagctgctgatctacgccgccagcagcctgcagagcggagtg cctagcaggttcagcggaagcggcagcggcaccgacttcaccctgaccatcagcagcctgcagcccgaggacttcgccacctactac tgcctgcaggactacaactaccccctgacattcggcggcggcaccaaggtggagatcaagcgtacggtggctgcaccatctgtcttc atcttcccgccatctgatgagcagttgaaatctggaactgcctctgttgtgtgcctgctgaataacttctatcccagagaggccaaa gtacagtggaaggtggataacgccctccaatcgggtaactcccaggagagtgtcacagagcaggacagcaaggacagcacctacagc ctcagcagcaccctgacgctgagcaaagcagactacgagaaacacaaagtctacgcctgcgaagtcacccatcagggcctgagctcg cccgtcacaaagagcttcaacaggggagagtgttag The frameworks for the select anti-TMEFF2 antibodies are shown in Table 69.

TABLE 69

| Antibody | VH framework | VH framework SEQ ID NO: | VL framework | VL framework SEQ ID NO: |
|---|---|---|---|---|
| TMEB675 | VH3_3-23 | 53 | VKI_L11 | 55 |
| TMEB570 | VH1_1-69 | 54 | VKIII_A27 | 591 |
| TMEB674 | VH3_3-23 | 53 | VKI_L11 | 55 |
| TMEB565 | VH1_1-69 | 54 | VKI_L11 | 55 |
| TMEB762 | VH3_3-23 | 53 | VKI_L11 | 55 |
| TMEB757 | VH3_3-23 | 53 | VKI_L11 | 55 |

(VH3_3-23 framework)
SEQ ID NO: 53
EVQLLESGGGLVQPGGSLRLSCAASGFTFSSYAMSWVRQAPGKGLEWVS

AISGSGGSTYYADSVKGRFTISRDNSKNTLYLQMNSLRAEDTAVYYCAK

WGQGTLVTVSS (VH1_1-69 framework)
SEQ ID NO: 54
QVQLVQSGAEVKKPGSSVKVSCKASGGTFSSYAISWVRQAPGQGLEWMG

GIIPIFGTANYAQKFQGRVTITADESTSTAYMELSSLRSEDTAVYYCAR

-continued (VKI_L11 framework)
SEQ ID NO: 55
aiqmtqspsslsasvgdrytitcrasqgirndlgwyqqkpgkapklliy aasslqsgypsrfsgsgsgtdftltisslqpedfatyyclqdynyp (VKIII_A27 framework)
SEQ ID NO: 591
EIVLTQSPGTLSLSPGERATLSCRASQSVSSSYLAWYQQKPGQAPRLLI

YGASSRATGIPDRFSGSGSGTDFTLTISRLEPEDFAVYYCQQYGSSP 7-5 Epitope Mapping of Anti-TMEFF2 Antibodies Epitope mapping of TMEB570 and TMEB675 was done using H/D exchange. TMEW1 (SEQ ID NO: 578) was used as source of TMEFF2 in these assays.

10 μg of TMEW1 in 130 μL of control buffer (50 mM phosphate, 100 mM sodium chloride at pH 7.4) was denatured by adding 130 μL of 4 M guanidine hydrochloride, 0.85 M TCEP buffer (final pH was 2.5) and incubating the mixture for 3 min at 10° C. The mixture was then subjected to on-column pepsin/protease XIII digestion using an in-house packed pepsin/protease XIII (w/w, 11) column (2.1× 30 mm). The resultant peptides were analyzed using an UPLC-MS system comprised of a Waters Acquity UPLC coupled to a Q Exactive™ Hybrid Quadrupole-Orbitrap Mass Spectrometer (Thermo). The peptides were separated on a 50×1 mm C8 column with a 16.5 min gradient from 2-34% solvent B (0.2% formic acid in acetonitrile). Solvent A was 0.2% formic acid in water. The injection valve and pepsin/protease XIII column and their related connecting tubings were kept inside a cooling box maintained at 10° C. The second switching valve, C8 column and their related connecting stainless steel tubings were inside another chilled circulating box maintained at −6° C. Peptide identification was done through searching MS/MS data against the TMEW1 sequence with Mascot. The mass tolerance for the precursor and product ions were 7 ppm ad 0.02 Da, respectively.

10 μL of TMEW1 (5 μg) or 10 μL of TMEW1 & TMEB570 or TMEB675 mixture (5 μg:15 μg) was incubated with 120 μL deuterium oxide labeling buffer (50 mM sodium phosphate, 100 mM sodium chloride at pH 7.4) for 0 s, 30 s, 360 s, 3600 s, or 14400 s at 10° C. Hydrogen/deuterium (H/D) exchange at each time point was performed in duplicate. Hydrogen/deuterium exchange was quenched by adding 130 μL of 4 M guanidine hydrochloride, 0.85 M TCEP buffer (final pH was 2.5). Subsequently, the quenched samples were subjected to on column pepsin/protease XIII digestion and LC-MS analysis as described above. The mass spectra were recorded in MS only mode.

Raw MS data was processed using HDX WorkBench, software for the analysis of H/D exchange MS data (Pascal et al., J. Am. Soc. Mass Spectrom. 2012, 23 (9), 1512-1521). The deuterium levels were calculated using the average mass difference between the deuteriated peptide and its native form (t0). About 97-99% of the protein could be mapped to specific peptides. The deuterium buildup curves showed significant difference in slopes, over exchange time for the peptides.

TMEB570 epitope: TMEW1 showed a modest reduction in deuterium uptake at residues 235-249 (residue numbering according to SEQ ID NO: 575), e.g. residues HGKCEHSINMQEPSC (SEQ ID NO: 592) within the membrane proximal region were protected from H/D exchange upon binding to TMEB570.

TMEB675 epitope: TMEW1 showed a modest reduction in deuterium uptake at residues 252-268 (residue numbering according to SEQ ID NO: 575), e.g. residues DAGYTGQHCEKKDYSVL (SEQ ID NO: 600) within the membrane proximal region were protected from H/D/exchange upon binding to TMEB675.

TMEB570 TMEFF2 epitope residues thus encompassed HGKCEHSINMQEPSC (SEQ ID NO: 592) and TMEB675 epitope residues encompassed DAGYTGQHCEKKDYSVL (SEQ ID NO: 600). Both antibodies bound TMEFF2 within the membrane proximal region.

7-6 Generation of Bispecific TMEFF2×CD3 Antibodies

Select monospecific anti-TMEFF2 and anti-CD3 antibodies (see Example 1-7) were expressed as IgG4/κ. F405L and R409K substitutions (EU numbering) were made into the anti-CD3 antibodies while the anti-TMEFF2 antibodies had wild-type IgG4. In addition to position 405 and 409 substitutions, the IgG4 mAbs were engineered to have S228P, F234A and L235A substitution.

The monospecific antibodies were expressed and purified using standard methods using a Protein A column (HiTrap MabSelect SuRe column). After elution, the pools were dialyzed into D-PBS, pH 7.2.

Bispecific TMEFF2×CD3 antibodies were generated by combining a monospecific TMEFF2 mAb and a monospecific CD3 mAb in in vitro Fab arm exchange as described in Int. Patent Publ. No. WO2011/131746. Briefly, at about 1-20 mg/ml at a molar ratio of 1:1 of each antibody in PBS, pH 7-7.4 and 75 mM 2-mercaptoethanolamine (2-MEA) was mixed together and incubated at 25-37° C. for 2-6 h, followed by removal of the 2-MEA via dialysis, diafiltration, tangential flow filtration and/or spinned cell filtration using standard methods.

The bispecific antibodies were further purified after the in vitro Fab-arm exchange using hydrophobic interaction chromatography to minimize residual parental anti-TMEFF2 and anti-CD3 antibodies using standard methods.

Table 73 and Table 74 show the generated bispecific antibodies.

TABLE 73

| Bispecific antibody | Parental (TMEFF2 arm/ CD3 arm) | HCDR1 | HCDR2 | HCDR3 | LCDR1 | LCDR2 | LCDR3 |
|---|---|---|---|---|---|---|---|
| TMCB132 | TMEB675 | 582 | 584 | 587 | 18 | 588 | 22 |
|  | CD3B376 | 662 | 663 | 664 | 671 | 673 | 690 |
| TMCB131 | TMEB570 | 583 | 585 | 16 | 19 | 21 | 23 |
|  | CD3B376 | 662 | 663 | 664 | 671 | 673 | 690 |
| TMCB150 | TMEB762 | 582 | 584 | 587 | 18 | 588 | 603 |
|  | CD3B376 | 662 | 663 | 664 | 671 | 673 | 690 |

TABLE 74

| Bispecific antibody | Parental (TMEFF2 arm/CD3 arm) | VH | VL | HC | LC |
|---|---|---|---|---|---|
| TMCB132 | TMEB675 | 25 | 28 | 32 | 35 |
|  | CD3B376 | 652 | 661 | 640 | 676 |
| TMCB131 | TMEB570 | 589 | 29 | 33 | 36 |
|  | CD3B376 | 652 | 661 | 640 | 676 |
| TMCB150 | TMEB762 | 604 | 607 | 614 | 615 |
|  | CD3B376 | 652 | 661 | 640 | 676 |

7-7 Characterization of Bispecific TMEFF2×CD3 Antibodies

Purity analysis by Analytical Ultra Centrifugation (AUC)

Analytical ultracentrifugation (AUC) allows for the determination of the size, shape, state of aggregation, and reversible interaction of macromolecules in solution. Sedimentation velocity (SV) is an AUC technique that allows for a concentration gradient of a macromolecule to move to the outer radius of the sample holder (cell) as the centrifuge spins. This enables the determination of the sedimentation coefficient which is a factor of the size and shape of a molecule, and it unique to each molecule. Beckman Optima AUC instrument was used for this purpose. The samples were loaded into centrifuge cells equipped with 1.2 cm Beckman centerpieces (rated to 50K rpm) and quartz windows. The cells are assembled and torqued to 130 lbs. The centrifuge cells were placed into an An-50 (8 hole) or An-60 (4 hole) rotor and placed within the AUC chamber. The temperature of the AUC was equilibrated to 20.5° C. for at least one hour with the rotor in the chamber before initiating the run. Runs were performed at 40K rpm for mAb sample with scan count (250 scans), frequency of scan collection (90 seconds), data resolution (10 PM), wavelength at 280 nm. The data were analyzed using the direct boundary fitting software SEDANAL. Purity of the bispecific antibody TMCB150 and its parental mAbs were measured. TMCB150 showed 97.1% monomer, 2.8% dimer monomer and no aggregation, as determined by AUC meeting acceptable criteria for transiently expressed research material for further biophysical characterization. TMEB762 showed 95.5% monomer, 4.5% dimer and no aggregation while CD3B376 showed 97.7% monomer and 2.2% dimer with no aggregation. Aggregate levels of >5% of a minimum two-step purified molecule could have a significant impact on biological activity, solubility, stability and shelf-life.

Conformational Stability of Anti-TMEFF2/CD3 Bispecific by DSC

TMCB150 thermal unfolding was determined by DSC (Differential Scanning Calorimetry) that showed an onset of unfolding Tm=52.6° C., the first thermal transition (Tm1) at 61.8° C., second thermal transition (Tm2) at 67.6° C. and third thermal transition (Tm3) at 75.5° C. Based on parental antibodies (anti-TMEFF2, TMEB762 and anti-CD3, CD3B376) thermal transition profile as assessed by DSC before, Tm1 of TMCB150 corresponds to CD3B376 FAB unfolding and Tm3 of TMCB150 corresponds to TMEB762 Fab unfolding transitions.

Serum Stability

Serum stability assay is developed to evaluate properties of lead candidates for non-specific or off-target binding to human serum components. This may be predictive of poor pharmacokinetics and bio distribution properties. Binding and stability of TMCB150 is evaluated in both buffer and human serum using a fluorescence-based chromatography method. Bispecific antibody is labeled with Alexa Fluor 488 conjugate (Invitrogen kit according to manufacturer's instructions), incubated in Hepes buffer and human serum (Sigma, cat #H4522) at 4° C. and 37° C. for 2 days and then analysed by SEC-HPLC using Agilent HPLC system equipped with fluorescence detector. Percent aggregate is calculated from the integration of area under the curve of each peak. TMCB150 showed 2.4% aggregation in Hepes buffer at time zero and 2.0% and 1.3% aggregation after two days at 4° and 370 Celcius, respectively. Inhuman serum, TMCB150 showed 1.7% aggregation at time zero and 1.1% aggregation after two days at both 4° and 37° Celcius.

Non-Specific Binding

Non-specific binding of the lead molecule to unrelated surfaces is determined by biosensor technology (Biacore 8K). Antibody is passed over SPR surfaces coated with unrelated proteins. If the antibody displays significant binding to these irrelevant surfaces, its predicted to have poor in-vivo properties and exhibit manufacturing challenges. Lead molecule is tested at the final concentration of 1 µM. Irrelevant surfaces include negatively charged protein (Soy Trypsin Inhibitor), positively charged protein (Lysozyme and β-defensin), hydrophobic (Rh-integrin a4b7), human IgG, sticky protein (Rh-CD19). Proper controls are used in this experiment. Lead is flown over two surfaces, one is a blank and the other has a molecule directly immobilized. The response unit (RU) level is determined by subtracting the blank RU from the test surface RU. The RU of TMCB150 and the parental mAbs are given below in the table. A response unit ≥100 predicts high risks for non-specific binding to charged/hydrophobic/IgG surfaces which would create challenges during manufacturing and translate to poor PK properties. None of the antibodies show non-specific binding to irrelevant surfaces predicting low to no risks for manufacturing and in-vivo behavior.

TABLE 75

|  | STI | B-Defensin-3 | Human IgG | Lysozyme | rh-Integrin a4b7 | rh-CD19 |
|---|---|---|---|---|---|---|
| TMCB150 | 1.6 | 6.4 | 7.5 | 4.2 | 0 | 3.4 |
| TMEB762 | 0 | 4.1 | 8.4 | 4.6 | 0 | 3.3 |
| CD3B376 | 19.5 | 3.1 | 0.4 | 0.2 | 0 | 0 |

High Concentration Stability

Many monoclonal antibodies are formulated at high concentration (≥100 mg/ml) to reduce injection volume to facilitate subcutaneous administration. In addition, all monoclonal antibodies are exposed to transiently high concentrations (≥50 mg/ml) during the purification process. High concentration stability is therefore a critical quality attribute for these molecules. Concentration is performed using centrifugal ultrafiltration devices with 30 kDa MWCO membranes. 5.1 to 5.3 mg of each protein were initially diluted to the same starting concentration and centrifuged at 4000×g in 15-minute intervals. At the end of each 15-minute centrifugation step, the concentrators are removed from the centrifuge and a visual estimate of the remaining sample volume is recorded. Concentration is measured by SoloVPE instrument. Concentrated samples were incubated at 4 C and 40 C for 2 weeks and aliquots were drawn at timed intervals to check for the integrity by analytical SEC. TMCB150 and the parental mAbs (CD3B376 and TMEB762) concentrated normally. Final concentration of TMCB150 was 99.4 mg/mL and that of the parental mAbs were 52.2 mg/mL (TMEB762) and 52.6 mg/mL (CD3B376). Concentration remained the same for 2 weeks at 4 C and 40 C suggesting that molecules have good intrinsic properties with no potential for aggregation or adsorption to the eppendorf tubes. % species (A: Aggregate; M: Monomer; F: Fragment) as measured from SEC peak integration is provided below in the table. At high concentration, molecules are intact with 4-5% aggregates and ≤0.3% fragments after storing for 2 weeks at 40 C predicting good shelf life.

TABLE 76

|  | Time Zero | | | 2 weeks, 4° C. | | | 2 weeks, 40° C. | | |
| --- | --- | --- | --- | --- | --- | --- | --- | --- | --- |
|  | A | M | F | A | M | F | A | M | F |
| TMCB150 | 0.8 | 99.2 | 0 | 1.4 | 98.6 | 0 | 3.6 | 96.1 | 0.3 |
| TMEB762 | 2.5 | 97.5 | 0 | 2.7 | 97.3 | 0 | 3.1 | 96.9 | 0 |
| CD3B376 | 1.1 | 98.9 | 0 | 2.5 | 97.5 | 0 | 5.1 | 94.7 | 0.2 |

Affinity Determination of Anti-TMEFF2/CD3 Bispecific Antibody by Kinetic Exclusion Assay (KinExA)

A KinExA 3200 instrument (Sapidyne Instruments, Inc.) was used to measure solution equilibrium affinity, $K_D$, of the bispecific mAb TMCB150 and its bivalent TMEFF2 parent TMEB762 mAb to human TMEFF2 extracellular domain (ECD). Serial dilutions of human TMEFF2 extracellular domain (ECD) were prepared with a constant concentration of anti-TMEFF2 mAb in 10 mM HEPES, 150 mM NaCL, 0.05% surfactant P20, pH 7.4, 0.1% BSA, and 0.02% NaN3. The reaction mixtures were incubated at RT until the binding interactions reached equilibrium. The duration of the incubation was determined using KinExA software simulation. Beads were prepared by direct covalent immobilization of TMEFF2-ECD by amine-coupling on pre-activated beads composed of bis-acrylamide/azlactone copolymer (Pierce Biotechnology, Inc.). After incubation the samples were run on the KinExA instrument to assess free antibody in the mixture by passing the mixture though the TMEFF2-modified beads, and detecting the captured antibody using a fluorescently labeled secondary antibody. The data was fit with a 1:1 binding model using the KinExA Pro software.

TABLE 77

| mAb sample | $K_D$ pM | 95% CI, $K_D$ pM |
| --- | --- | --- |
| TMCB150 | 63.6 | 55.8-71.9 |
| TMEB762 | 46.1 | 38.0-55.1 |

Measurement of Binding Affinity of Anti-TMEFF2/CD3 Bispecific Antibody to N-Terminal CD3ε Peptide Kinetic rate constants were measured by SPR performed using Biacore 8K (GE Healthcare) and anti-human Fc biosensor surfaces. Anti-human immunoglobulin antibodies were covalently coupled to the surface of a CM4 sensor chip (GE Healthcare). Antibodies of interest were captured on the anti-human immunoglobulin sensor chip, followed by injection of N-terminal CD3E peptide at various concentrations in HEPES Buffered Saline containing 0.05% surfactant P20 (Tween™ 20) and 100 ug/mL BSA. The surface was regenerated with 2 pulses injections of 30 μL of 0.8% phosphoric acid at 100 μL/min. Data reported is the difference in SPR signal between the flow cell containing the captured antibody and a reference cell without captured antibody. Additional instrumental contributions to the signal were removed by subtraction of the data from the blank injection from the reference-subtracted signal. The data was analyzed by fitting association and dissociation phases at all concentrations (global fit) with a 1:1 binding model using the Biaevaluation software (Biacore, Inc.). Data is reported as average+95% CI (Confidence Interval) which is calculated by t value for 95% CI*stdev/square root of the number of replicates.

TABLE 78

| mAb sample | Average $k_{on}$ (1/Ms) | Average $k_{off}$ (1/s) | Average $K_D$, nM | 95% CI, $K_D$ pM |
| --- | --- | --- | --- | --- |
| TMCB150 | 3.57E+04 | 1.03E−03 | 28.7 | 24.4-34.3 |
| CD3B376 | 4.33E+04 | 1.17E−03 | 26.9 | 21.1-34.4 |

7-8 Bispecific TMEFF2×CD3 Antibodies are Effective in T-Cell Mediated Killing of Prostate Cancer Cells
T-Cell Mediated Killing of Prostate Cancer Cells Select bispecific TMEFF2×CD3 antibodies were assessed for their ability to mediate T-cell mediated killing of prostate cancer cells.

T-cell mediated killing of the TMEFF2×CD3 bispecific antibodies was measured using a caspase cytotoxicity assay that indirectly measures cell killing via cleavage of a fluorescent substrate by active caspase 3/7. Cleavage of the substrate results in a fluorescent DNA dye, with fluorescence restricted to the cell nucleus. Repeated fluorescence measurements are taken in each well throughout the course of the assay, using a motorized 10× objective, capable of precisely imaging well(s) at the same coordinates. Target cell populations are identified based on defined size restrictions and/or through the use of a secondary label.

Frozen Pan $CD3^+$ T-cells (Biological Specialty Corporation, Colmar, Pa.) were isolated by negative selection from normal healthy donors. Prostate cancer cells expressing TMEFF2 (LNCaP-AR) were cultured in RPMI 1640 with 10% HI FBS+supplements (Life Technologies). T-cells and target cells were combined at an effector to target ratio (E:T) of 3:1 in Phenol Red free RPMI+10% FBS and supplements (Life Technologies), without selection reagents, and 0.6 uL of NucView caspase reagent (Essen Bioscience) was added to each mL of cells, per manufacturer guidelines. A total volume of 0.1 mL cells were added to appropriate wells of a clear, 96-well flat-bottom plate (BD Falcon). TMEFF2× CD3 bispecific antibodies were prepared at 2× final concentration in Phenol Red free RPMI, prepared as indicated above, and 0.1 mL of compounds were added to each well. After 30 minute incubation at room temperature to minimize cell aggregation at the edge of wells, plates were transferred to the Zoom Incucyte instrument (Essen Bioscience) held at 37° C., 5% $CO_2$.

Processing definitions on the Incucyte were designed for each cell line tested, per manufacture guidelines. Measurements were taken every six hours, until a plateau in the caspase signal was observed, and followed by three or more successive decreases from the maximum signal in the well(s) containing the highest concentration of the test compound(s).

After the assay was complete, each plate was analyzed using the appropriate processing definition. Raw fluorescent data was exported from the Incucyte Zoom software, and pasted into GraphPad Prism (GraphPad Software, Inc., La Jolla, Calif.). Caspase 3/7 activity was determined by calculating the area under the curve (AUC) for each well in GraphPad. AUC values were plotted as a function of Log 10 nM compound. The EC50 for each dose curve, in nanomolar (nM), was reported following non-linear regression analysis (4 parameter fit, least ordinary squares). Each assay contained a minimum of three biologic replicates, and each cell line was tested using T-cells from five healthy donors. Data were further analyzed by non-clinical statistics using a non-linear regression model.

Bispecific TMEFF2×CD3 Antibodies are Effective in In Vivo Prostate Cancer Tumor Models Select bispecific antibodies were tested in ex vivo LnCaP prostate cancer model in male NSG mice. For the study, $10^6$LnCaP cells in 50% Cultrex in 0.2 mL/animal were administered by subcutaneous injection into right flank on Day 0. The animals were randomized when tumors reached a volume of about ~100-150 mm$^3$ and injected $20^6$ T-cells intraperitoneally/mouse at day 15. Ten animals were in each group. Treatment with the antibodies began 1-3 days post T-cell injections. Antibodies were administered intraperitoneally twice a week. Prior to dosing, all animals received IVIG+Fc Block. Tumor volume and body weight was assessed twice a week until tumors reached ~1200 mm$^3$. Treatment groups are shown in Table 79. CD3×Null antibody was used as a negative control in these assays, having a CD3 binding arm and a null arm binding HIV gp120.

TABLE 79

| Group | Treatment | Dose |
|---|---|---|
| 1 | CD3xNull | 5 mg/kg |
| 6 | TMCB131 (TMEB570 x | 5 mg/kg |
| 7 | TMCB131 (TMEB570 x | 0.5 mg/kg |
| 8 | TMCB132 (TMEB675 x | 5 mg/kg |
| 9 | TMCB132 (TMEB675 x | 0.5 mg/kg |

Table 80 shows the percent tumor growth inhibition on day 38 per each group post tumor implant.

FIG. 71 shows the reduction in mean tumor volume over time post tumor implant. FIG. 72 shows the reduction in mean tumor volume of each mouse treated with 0.05, 0.1 or 0.5 mg/kg TMEB762×CD3B376.

TABLE 80

| Treatment | % TGI on day 38 |
|---|---|
| CNTO7008 (Null x CD3) | |
| TMCB132 (TMEB675 x CD3B376) 5 mg/kg | 48 |
| TMCB132 (TMEB675 x CD3B376) 0.5 mg/kg | 47.7 |
| TMCB131 (TMEB570 x CD3B376) 5 mg/kg | 23.3 |
| TMCB131 (TMEB570 x CD3B376) 0.5 mg/kg | 35 |

Efficacy of TMEB762×CD3B376 (TMCB150) was also evaluated in established LNCaP xenografts in male NOD.Cg-Prkd$^{scid}$ Il2rg$^{tm1Wj1}$/SzJ (NSG) mice humanized with 20e6 T cells. Animals were randomized into groups of 10 animals each by mean tumor volume on day 13 post tumor implantation. TMEB762×CD3B376 at 0.5, 0.1 and 0.05 mg/kg or null×CD3B376 antibody control at 0.5 mg/kg were dosed IP twice weekly for 5 weeks. On day 35 post-tumor implantation, when at least eight animals remained per group, tumor growth inhibition (% TGI) as determined by tumor volume was calculated. Statistically significant tumor growth inhibition was observed with TMEB762×CD3B376 at 0.5 and 0.1 mg/kg, but not at 0.05 mg/kg, as compared to null×CD3 control (FIG. 72, $p<0.0001$). TMEB762×CDB376 at 0.5, 0.1, and 0.05 mg/kg elicited tumor growth inhibition of 110%, 88% and 25%, respectively, as compared to null×CD3 treated controls. TMEB762×CDB376 treatment resulted in seven and three complete responses at 0.5 and 0.1 mg/kg, respectively. Subcutaneous LNCaP tumors were measured by caliper twice weekly and the results presented as mean tumor volume (mm$^3$)±SEM (≥8 mice remaining per group).

T Cell Activation in Response to Administration of TMCB132

T cell activation in LnCaP prostate cancer cells was measured by flow cytometry, specifically by assessing CD25 positivity of CD3+/CD8+ T cells in 6 separate normal healthy donors (9642, 9672, 9762, 9772, 9832, 9852) 72 hours after treatment with TMCB132 (FIG. 73). Activation of CD3+ pan-T cells added at a 3:1 effector:target ratio was observed in response to administration of TMCB132 on LnCaP prostate cancer cells.

T-Cell Mediated Cytotoxicity of TMCB132 In Vitro.

T-cell-mediated cytotoxicity assay was used to evaluate the cytotoxicity potential of TMCB132 in vitro, using live-time lapse imaging on the Incucyte platform. TMCB132 was tested in TMEFF2 positive cell line LnCaP, in presence of isolated pan human CD3+ T cells from healthy donors at a (Effector:Target) effector:target ratio (E:T ratio) of 3:1. Cell death by apoptosis was monitored by measuring the fluorescence signal for active caspase-3/7 over a time period of 96 hours. TMCB132 promoted a dose-dependent reduction of viable LnCaP cells with increasing time. Dose-dependent increase in caspase-3/7 activity or fluorescence signal indicated cell death in LnCaP cells in presence of the T cells (FIG. 74). The data suggests that TMCB132 is effective in inducing T cell-mediated death in the LnCaP tumor cells.

Efficacy of TMCB132 in Established SC Human Prostate Xenograph in T-Cell Humanized Mice.

The antitumor efficacy of TMCB132 was evaluated in established subcutaneous (SC) human prostate LNCaP xenografts in male NOD.Cg-Prkdc$^{scid}$ Il2rg$^{tm1Wj1}$/SzJ (NSG, The Jackson Laboratory, Bar Harbor, Me.) mice humanized with 20e$^6$ T cells. Animals were randomized into groups of 10 animals each by mean tumor volume on day 13 post tumor implantation. TMCB132 at 0.5, 0.1 and 0.05 mg/kg or null×CD3B219 antibody control at 0.5 mg/kg were dosed IP twice weekly for 4 weeks. On day 45 post-tumor implantation, when at least seven animals remained per group, tumor growth inhibition (% TGI) as determined by tumor volume was calculated. Statistically significant tumor growth inhibition was observed with TMCB132 at 0.5 and 0.1 mg/kg and 0.05 mg/kg, as compared to null×CD3 control (FIG. 75, $p<0.0001$). TMCB132 at 0.5, 0.1, and 0.05 mg/kg elicited tumor growth inhibition of 102%, 109% and 47%, respectively, as compared to null×CD3 treated controls. TMCB132 treatment resulted in three, two and one complete responses at 0.5, 0.1 and 0.05 mg/kg, respectively.

SEQUENCE LISTING (729 sequences)

SEQ ID NO: 1 - protein, 17 aa, Artificial Sequence
  Description of Artificial Sequence: Synthetic peptide
EISGSGGYTNYADSMKG

SEQ ID NO: 2 - protein, 17 aa, Artificial Sequence
  Description of Artificial Sequence: Synthetic peptide
EISGSGGYTNYADSMKS

SEQ ID NO: 3 - protein, 17 aa, Artificial Sequence
  Description of Artificial Sequence: Synthetic peptide
EISGSGGYTNYADSLKG

SEQ ID NO: 4 - protein, 11 aa, Artificial Sequence
  Description of Artificial Sequence: Synthetic peptide
RASQSVSNYLA

SEQ ID NO: 5 - protein, 9 aa, Artificial Sequence
  Description of Artificial Sequence: Synthetic peptide
QQRGNWPLT

SEQ ID NO: 6 - protein, 124 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSMKGRFTISRDNSKNTLYLQMNSLRAEDTAVYYCARDSYDSSLYVGDYFDYWGQGTLVTVSS

SEQ ID NO: 7 - protein, 124 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSMKSRFTISRDNSKNTLYLQMNSLRAEDTAVYYCARDSYDSSLYVGDYFDYWGQGTLVTVSS

SEQ ID NO: 8 - protein, 124 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSLKGRFTISRDNSKNTLYLQMNSLRAEDTAVYYCARDSYDSSLYVGDYFDYWGQGTLVTVSS

SEQ ID NO: 9 - protein, 107 aa, Artificial Sequence
  Description of Artificial Sequence: Synthetic polypeptide
EIVLTQSPATLSLSPGERATLSCRASQSVSNYLAWYQQKPGQAPRLLIHDASNRATGIPARFSGSGSGTDFTLTISSLEPEDFAVYYCQQRRNWPLTFGQGTKVEIK

SEQ ID NO: 10 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRGNWPLTFGQGTKVEIK

SEQ ID NO: 11 - protein, 451 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSMKGRFTISRDNSKNTLYLQMNSLRAEDTAVYYCARDSYDSSLYVGDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 12 - protein, 451 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSMKSRFTISRDNSKNTLYLQMNSLRAEDTAVYYCARDSYDSSLYVGDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 13 - protein, 451 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSLKGRFTISRDNSKNTLYLQMNSLRAEDTAVYYCARDSYDSSLYVGDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 14 - protein, 214 aa, Artificial Sequence
  Description of Artificial Sequence: Synthetic polypeptide
EIVLTQSPATLSLSPGERATLSCRASQSVSNYLAWYQQKPGQAPRLLIHDASNRATGIPARFSGSGSGTDFTLTISSLEPEDFAVYYCQQRRNWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRGNWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 15 aa, Artificial Sequence
  Description of Artificial Sequence: Synthetic peptide
DGYSSGRSTTYAFDY

SEQ ID NO: 17 - protein, 9 aa, Artificial Sequence
  Description of Artificial Sequence: Synthetic peptide
MPLNSPHDC

SEQ ID NO: 18 - protein, 11 aa, Artificial Sequence
  Description of Artificial Sequence: Synthetic peptide
RASQGIRNDLG

SEQ ID NO: 19 - protein, 12 aa, Artificial Sequence
  Description of Artificial Sequence: Synthetic peptide
RASQSVSTYYLA

SEQ ID NO: 20 - protein, 120 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSS

SEQ ID NO: 21 - protein, 7 aa, Artificial Sequence
  Description of Artificial Sequence: Synthetic peptide
GASYRAT

SEQ ID NO: 22 - protein, 9 aa, Artificial Sequence
  Description of Artificial Sequence: Synthetic peptide
LQDYNYALT

SEQ ID NO: 23 - protein, 9 aa, Artificial Sequence
  Description of Artificial Sequence: Synthetic peptide
QQYGHSPIT

SEQ ID NO: 24 - protein, 9 aa, Artificial Sequence
  Description of Artificial Sequence: Synthetic peptide
LQDYNYSLT

SEQ ID NO: 25 - protein, 118 aa, Artificial Sequence
  Description of Artificial Sequence: Synthetic polypeptide
EVQLLESGGGLVQRGGSLRPSCAASGFTFSSYSMSWVRQAPGKGLEWVSVISGSGGFTDYADSVKGRFTISRDNSKNTLYLHMNSLRAEDTAVYYCARMPLNSPHDYWGQGTLVTVSS

SEQ ID NO: 26 - protein, 120 aa, Artificial Sequence
  Description of Artificial Sequence: Synthetic polypeptide
QLQLQESGPGLVKPSETLSLTCTVSGGSISSSSYYWGWIRQPPGKGLDWIGSINYSGSTYYNPSLKSRVTISVDTSKIQFSLKLRSVTAADTAVYYCARLDGYESPFDYWGQGTLVTVSS

SEQ ID NO: 27 - protein, 119 aa, Artificial Sequence
  Description of Artificial Sequence: Synthetic polypeptide
EVQLLESGGGLVQPPGGSLRLSCAASGFTFSSYSMSWVRQAPGKGLEWVSVISGGGSFTSYADSVKGRFTISRDNSNNTLYLQMSSLRAEDTAFYYCARMPLNSPHDCWGQGTLVTVSS

SEQ ID NO: 28 - protein, 107 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYCLQDYNYALTFGGGTKVEIK

SEQ ID NO: 29 - protein, 108 aa, Artificial Sequence
  Description of Artificial Sequence: Synthetic polypeptide
EIVLTQSPGTLSLSPGERATLSCRASQSVSTYYLAWYQQKPGQAPRLLIYGASYRATGIPDRFSGSGSGTDFTLTISRLEPEDFAVYYCQQYGHSPITFGQGTKVEIK

SEQ ID NO: 30 - protein, 107 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYCLQDYNYSLTFGGGTKVEIR

SEQ ID NO: 31 - protein, 108 aa, Artificial Sequence
  Description of Artificial Sequence: Synthetic polypeptide
EIVLTQSPGTLSLSPGERATLSCRASQSVATYYLAWYQQKPGQAPRLLIYGASSRATGIPDRFSGSGSGTDFTLTISRLEPEDFAVYYCQQYGYNPITFGQGTKVEIK

SEQ ID NO: 32 - protein, 445 aa, Artificial Sequence
  Description of Artificial Sequence: Synthetic polypeptide
EVQLLESGGGLVQRGGSLRPSCAASGFTFSSYSMSWVRQAPGKGLEWVSVISGSGGFTDYADSVKGRFTISRDNSKNTLYLHMNSLRAEDTAVYYCARMPLNSPHDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 33 - protein, 451 aa, Artificial Sequence
  Description of Artificial Sequence: Synthetic polypeptide
QVQLVQSGAEVKKPGSSVKVSCKASGGTFSSYYISWVRQAPGQGLEWMGGIIPISGRANYAQKFQGRVTITADESTSTAYMELSSLRSEDTAVYYCARDGYSSGRSTTYAFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 34 - protein, 446 aa, Artificial Sequence
  Description of Artificial Sequence: Synthetic polypeptide
EVQLLESGGGLVQPPGGSLRLSCAASGFTFSSYSMSWVRQAPGKGLEWVSVISGGGSFTSYADSVKGRFTISRDNSNNTLYLQMSSLRAEDTAFYYCARMPLNSPHDCWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 35 - protein, 214 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYCLQDYNYALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36 - protein, 215 aa, Artificial Sequence
  Description of Artificial Sequence: Synthetic polypeptide
EIVLTQSPGTLSLSPGERATLSCRASQSVSTYYLAWYQQKPGQAPRLLIYGASYRATGIPDRFSGSGSGTDFTLTISRLEPEDFAVYYCQQYGHSPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 37 - protein, 214 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYCLQDYNYSLTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 38 - protein, 215 aa, Artificial Sequence
  Description of Artificial Sequence: Synthetic polypeptide
EIVLTQSPGTLSLSPGERATLSCRASQSVATYYLAWYQQKPGQAPRLLIYGASSRATGIPDRFSGSGSGTDFTLTISRLEPEDFAVYYCQQYGYNPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39 - DNA, 354 bp, Artificial Sequence
  Description of Artificial Sequence: Synthetic polynucleotide
gaggtgcagctgctggaaagcggcggaggcctggtgcagagaggaggaagcctgagacccagctgtgccgccagcggcttcaccttcagcagctacagcatgagctgggtcaggcaggcccctggcaaaggactggagtgggtgagcgtgattagcggcagcggcggcttcaccgattacgccgacagcgtgaagggcaggttcaccatcagcagggacaatagcaagaacaccctgtacctgcacatgaacagcctgagggccgaggacaccgccgtgtactactgcgccaggatgcccctgaacagccctcacgactactggggccagggaaccctggtgaccgtgtccagc

SEQ ID NO: 40 - DNA, 372 bp, Artificial Sequence
  Description of Artificial Sequence: Synthetic polynucleotide
caggtgcagctggtgcagagcggcgcggaagtgaaaaaaccgggcagcagcgtgaaagtgagctgcaaagcgagcggcggcaccttcagctcctattacattagctgggtgcgccaggcgccgggccagggcctggaatggatgggtggcattatcccaatcagtgggcgtgctaattatgcgcagaaatttcagggccgcgtgaccattaccgctgatgaaagcaccagcaccgcgtatatggaactgagcagcctgcgcagcgaagataccgcggtgtattattgcgcgcgcgacggctacagtagtggacgtagcacaacatacgcatttgactattggggccagggcaccctggtgaccgtgtcgagt

SEQ ID NO: 41 - DNA, 357 bp, Artificial Sequence
  Description of Artificial Sequence: Synthetic polynucleotide
gaagtgcagctgctggagagcggaggaggactggtgcagcctcctggcggaagcctgagactgagctgcgccgctagcggcttcaccttcagcagctacagcatgagctgggtgagacaggctcctggcaagggcctggagtgggtgagcgtgatcagcggcggaggcagctttaccagctacgccgacagcgtgaagggcaggttcaccatcagcagggacaacagcaacaacaccctgtacctgcagatgagcagcctgagggccgaggacaccgccttctactactgcgccaggatgcccctgaacagcccccatgactgctggggacagggcaccctggtgaccgtgagcagc

SEQ ID NO: 42 - DNA, 321 bp, Artificial Sequence
  Description of Artificial Sequence: Synthetic polynucleotide
gccatccagatgacccagagccctagcagcctgagcgctagcgtgggcgacagggtgaccatcacctgcagggccagccagggcatcagaaacgacctgggctggtaccagcagaagcccggcaaggcccccaagctgctgatctacgccgccagcagcctgcagagcggagtgcctagcaggttcagcggaagcggcagcggcaccgacttcaccctgaccatcagcagcctgcagcccgaggacttcgccacctactactgcctgcaggactacaactacgccctgacattcggcggcggcaccaaggtggagatcaag

SEQ ID NO: 43 - DNA, 324 bp, Artificial Sequence
  Description of Artificial Sequence: Synthetic polynucleotide
gaaattgtgctgacccagagcccgggcaccctgagcctgagcccgggcgaacgcgcgaccctgagctgccgcgcgagccagagcgtttccacatactacctggcgtggtatcagcagaaaccgggccaggcgccgcgcctgctgatttacggtgcctcctatcgcgcgaccggcattccggatcgctttagcggcagcggttccggcaccgattttaccctgaccattagccgcctggaaccggaagattttgcggtgtattattgccagcagtacggtcacagcccgattacttttggccagggcaccaaagtggaaatcaaa

SEQ ID NO: 44 - DNA, 321 bp, Artificial Sequence
  Description of Artificial Sequence: Synthetic polynucleotide
gccatccagatgacccagagccctagcagcctgagcgctagcgtgggcgacagggtgaccatcacctgcagggccagccagggcatcaggaacgacctgggctggtaccagcagaagcccggcaaggcccccaagctgctgatctacgccgccagcagcctgcagagcggagtgcctagcaggttcagcggcagcggaagcggcaccgacttcaccctgaccatctccagcctgcagcccgaggacttcgccacctactactgcctgcaggactacaactacagcctgaccttcggcggcggcaccaaggtggagatcagg

SEQ ID NO: 45 - DNA, 324 bp, Artificial Sequence
  Description of Artificial Sequence: Synthetic polynucleotide
gaaattgtgctgacccagagcccgggcaccctgagcctgagcccgggcgaacgcgcgaccctgagctgccgcgcgagccagagcgttgccacctattatcttgcgtggtatcagcagaaaccgggccaggcgccgcgcctgctgatttacggtgcatcctcccgtgcgaccggcattccggatcgctttagcggcagcggttccggcaccgattttaccctgaccattagccgcctggaaccggaagattttgcggtgtattattgccagcagtacggctataacccaattacctttggccagggcaccaaagtggaaatcaaa

SEQ ID NO: 46 - DNA, 1335 bp, Artificial Sequence
  Description of Artificial Sequence: Synthetic polynucleotide
gaggtgcagctgctggaaagcggcggaggcctggtgcagagaggaggaagcctgagacccagctgtgccgccagcggcttcaccttcagcagctacagcatgagctgggtcaggcaggcccctggcaaaggactggagtgggtgagcgtgattagcggcagcggcggcttcaccgattacgccgacagcgtgaagggcaggttcaccatcagcagggacaatagcaagaacaccctgtacctgcacatgaacagcctgagggccgaggacaccgccgtgtactactgcgccaggatgcccctgaacagccctcacgactactggggccagggaaccctggtgaccgtgtccagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 47 - DNA, 1353 bp, Artificial Sequence
  Description of Artificial Sequence: Synthetic polynucleotide
caggtgcagctggtgcagagcggcgcggaagtgaaaaaaccgggcagcagcgtgaaagtgagctgcaaagcgagcggcggcaccttcagctcctattacattagctgggtgcgccaggcgccgggccagggcctggaatggatgggtggcattatcccaatcagtgggcgtgctaattatgcgcagaaatttcagggccgcgtgaccattaccgctgatgaaagcaccagcaccgcgtatatggaactgagcagcctgcgcagcgaagataccgcggtgtattattgcgcgcgcgacggctacagtagtggacgtagcacaacatacgcatttgactattggggccagggcaccctggtgaccgtgtcgagtgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 48 - DNA, 1338 bp, Artificial Sequence
  Description of Artificial Sequence: Synthetic polynucleotide
gaagtgcagctgctggagagcggaggaggactggtgcagcctcctggcggaagcctgagactgagctgcgccgctagcggcttcaccttcagcagctacagcatgagctgggtgagacaggctcctggcaagggcctggagtgggtgagcgtgatcagcggcggaggcagctttaccagctacgccgacagcgtgaagggcaggttcaccatcagcagggacaacagcaacaacaccctgtacctgcagatgagcagcctgagggccgaggacaccgccttctactactgcgccaggatgcccctgaacagcccccatgactgctggggacagggcaccctggtgaccgtgagcagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacctgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 49 - DNA, 642 bp, Artificial Sequence
  Description of Artificial Sequence: Synthetic polynucleotide
gccatccagatgacccagagccctagcagcctgagcgctagcgtgggcgacagggtgaccatcacctgcagggccagccagggcatcagaaacgacctgggctggtaccagcagaagcccggcaaggcccccaagctgctgatctacgccgccagcagcctgcagagcggagtgcctagcaggttcagcggaagcggcagcggcaccgacttcaccctgaccatcagcagcctgcagcccgaggacttcgccacctactactgcctgcaggactacaactacgccctgacattcggcggcggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 50 - DNA, 645 bp, Artificial Sequence
  Description of Artificial Sequence: Synthetic polynucleotide
gaaattgtgctgacccagagcccgggcaccctgagcctgagcccgggcgaacgcgcgaccctgagctgccgcgcgagccagagcgtttccacatactacctggcgtggtatcagcagaaaccgggccaggcgccgcgcctgctgatttacggtgcctcctatcgcgcgaccggcattccggatcgctttagcggcagcggttccggcaccgattttaccctgaccattagccgcctggaaccggaagattttgcggtgtattattgccagcagtacggtcacagcccgattacttttggccagggcaccaaagtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 51 - DNA, 642 bp, Artificial Sequence
  Description of Artificial Sequence: Synthetic polynucleotide
gccatccagatgacccagagccctagcagcctgagcgctagcgtgggcgacagggtgaccatcacctgcagggccagccagggcatcaggaacgacctgggctggtaccagcagaagcccggcaaggcccccaagctgctgatctacgccgccagcagcctgcagagcggagtgcctagcaggttcagcggcagcggaagcggcaccgacttcaccctgaccatctccagcctgcagcccgaggacttcgccacctactactgcctgcaggactacaactacagcctgaccttcggcggcggcaccaaggtggagatcaggcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 52 - protein, 110 aa, Artificial Sequence
  Description of Artificial Sequence: Synthetic polypeptide
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVL

SEQ ID NO: 53 - protein, 109 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWGQGTLVTVSS

SEQ ID NO: 54 - protein, 98 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAR

SEQ ID NO: 55 - protein, 95 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYCLQDYNYP

SEQ ID NO: 56 - protein, 5 aa, Artificial Sequence
  Description of Artificial Sequence: Synthetic peptide
SYWIS

SEQ ID NO: 57 - protein, 17 aa, Artificial Sequence
  Description of Artificial Sequence: Synthetic peptide
IIYPGDSYTRYSPSFQG

SEQ ID NO: 58 - protein, 13 aa, Artificial Sequence
  Description of Artificial Sequence: Synthetic peptide
DYEWELFDSRLDY

SEQ ID NO: 59 - protein, 11 aa, Artificial Sequence
  Description of Artificial Sequence: Synthetic peptide
RASQSISSYLN

SEQ ID NO: 60 - protein, 7 aa, Artificial Sequence
  Description of Artificial Sequence: Synthetic peptide
AASSLQS

SEQ ID NO: 61 - protein, 7 aa, Artificial Sequence
  Description of Artificial Sequence: Synthetic peptide
QQSYSTP

SEQ ID NO: 62 - protein, 5 aa, Artificial Sequence
  Description of Artificial Sequence: Synthetic peptide
NAWIS

SEQ ID NO: 63 - protein, 17 aa, Artificial Sequence
  Description of Artificial Sequence: Synthetic peptide
WINPESGRANYAQKFQG

SEQ ID NO: 64 - protein, 16 aa, Artificial Sequence
  Description of Artificial Sequence: Synthetic peptide
ELYYLVYSTYYYAFDY

SEQ ID NO: 65 - protein, 11 aa, Artificial Sequence
  Description of Artificial Sequence: Synthetic peptide
RASQSIDRWLN

SEQ ID NO: 66 - protein, 9 aa, Artificial Sequence
  Description of Artificial Sequence: Synthetic peptide
QQSPRYPLT

SEQ ID NO: 67 - protein, 5 aa, Artificial Sequence
  Description of Artificial Sequence: Synthetic peptide
SYDIS

SEQ ID NO: 68 - protein, 17 aa, Artificial Sequence
  Description of Artificial Sequence: Synthetic peptide
GIIPIEGTANYAQKFQG

SEQ ID NO: 69 - protein, 10 aa, Artificial Sequence
  Description of Artificial Sequence: Synthetic peptide
DYPAGYGFDY

SEQ ID NO: 70 - protein, 12 aa, Artificial Sequence
  Description of Artificial Sequence: Synthetic peptide
RASQSVSSSYLA

SEQ ID NO: 71 - protein, 7 aa, Artificial Sequence
  Description of Artificial Sequence: Synthetic peptide
GASSRAT

SEQ ID NO: 72 - protein, 9 aa, Artificial Sequence
  Description of Artificial Sequence: Synthetic peptide
QQYGSSPLT

SEQ ID NO: 73 - protein, 5 aa, Artificial Sequence
  Description of Artificial Sequence: Synthetic peptide
SDWMS

SEQ ID NO: 74 - protein, 17 aa, Artificial Sequence
  Description of Artificial Sequence: Synthetic peptide
AISGNGGSTEYADSVKG

SEQ ID NO: 75 - protein, 16 aa, Artificial Sequence
  Description of Artificial Sequence: Synthetic peptide
DPYYYYDGDSYYGMDV

SEQ ID NO: 76 - protein, 11 aa, Artificial Sequence
  Description of Artificial Sequence: Synthetic peptide
RASQSISSYLN

SEQ ID NO: 77 - protein, 374 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 78 - protein, 5 aa, Artificial Sequence
  Description of Artificial Sequence: Synthetic peptide
SDAMH

SEQ ID NO: 79 - protein, 17 aa, Artificial Sequence
  Description of Artificial Sequence: Synthetic peptide
EISGSGGYTNYADSVKG

SEQ ID NO: 80 - protein, 15 aa, Artificial Sequence
  Description of Artificial Sequence: Synthetic peptide
DSYDSSLYVGDYFDY

SEQ ID NO: 81 - protein, 11 aa, Artificial Sequence
  Description of Artificial Sequence: Synthetic peptide
RASQSVSSYLA

SEQ ID NO: 82 - protein, 7 aa, Artificial Sequence
  Description of Artificial Sequence: Synthetic peptide
DASNRAT

SEQ ID NO: 83 - protein, 9 aa, Artificial Sequence
  Description of Artificial Sequence: Synthetic peptide
QQRSNWPLT

SEQ ID NO: 84 - protein, 5 aa, Artificial Sequence
  Description of Artificial Sequence: Synthetic peptide
SYAIS

SEQ ID NO: 85 - protein, 17 aa, Artificial Sequence
  Description of Artificial Sequence: Synthetic peptide
WISPYNGNANYAQKFQG

SEQ ID NO: 86 - protein, 10 aa, Artificial Sequence
  Description of Artificial Sequence: Synthetic peptide
DSDRSYNLDY

SEQ ID NO: 87 - protein, 11 aa, Artificial Sequence
  Description of Artificial Sequence: Synthetic peptide
RASQSISGWLN

SEQ ID NO: 88 - protein, 9 aa, Artificial Sequence
  Description of Artificial Sequence: Synthetic peptide
QQSYSTPLT

SEQ ID NO: 89 - protein, 5 aa, Artificial Sequence
  Description of Artificial Sequence: Synthetic peptide
SYWIG

SEQ ID NO: 90 - protein, 17 aa, Artificial Sequence
  Description of Artificial Sequence: Synthetic peptide
IIYPGDSDTRYSPSFQG

SEQ ID NO: 91 - protein, 9 aa, Artificial Sequence
  Description of Artificial Sequence: Synthetic peptide
GLPIWYLDY

SEQ ID NO: 92 - protein, 11 aa, Artificial Sequence
  Description of Artificial Sequence: Synthetic peptide
RASQSVASDLA

SEQ ID NO: 93 - protein, 7 aa, Artificial Sequence
  Description of Artificial Sequence: Synthetic peptide
FASNRAT

SEQ ID NO: 94 - protein, 9 aa, Artificial Sequence
  Description of Artificial Sequence: Synthetic peptide
QQSITWPFT

SEQ ID NO: 95 - protein, 5 aa, Artificial Sequence
  Description of Artificial Sequence: Synthetic peptide
SYAIS

SEQ ID NO: 96 - protein, 17 aa, Artificial Sequence
  Description of Artificial Sequence: Synthetic peptide
WIIPYNGNANYAQKFQG

SEQ ID NO: 97 - protein, 13 aa, Artificial Sequence
  Description of Artificial Sequence: Synthetic peptide
VNSAALVWERLDY

SEQ ID NO: 98 - protein, 17 aa, Artificial Sequence
  Description of Artificial Sequence: Synthetic peptide
GIIPIFGTANYAQKFQG

SEQ ID NO: 99 - protein, 14 aa, Artificial Sequence
  Description of Artificial Sequence: Synthetic peptide
ASRVWHASYGYLDY

SEQ ID NO: 100 - protein, 11 aa, Artificial Sequence
  Description of Artificial Sequence: Synthetic peptide
RASQSVSKWLA

SEQ ID NO: 101 - protein, 9 aa, Artificial Sequence
  Description of Artificial Sequence: Synthetic peptide
QQRFTAPWT

SEQ ID NO: 102 - protein, 10 aa, Artificial Sequence
  Description of Artificial Sequence: Synthetic peptide
GWAYDRGLDY

SEQ ID NO: 103 - protein, 17 aa, Artificial Sequence
  Description of Artificial Sequence: Synthetic peptide
KSSQSVLYSSNNKNYLA

SEQ ID NO: 104 - protein, 7 aa, Artificial Sequence
  Description of Artificial Sequence: Synthetic peptide
WASTRES

SEQ ID NO: 105 - protein, 9 aa, Artificial Sequence
  Description of Artificial Sequence: Synthetic peptide
QQYYSTPLT

SEQ ID NO: 106 - protein, 10 aa, Artificial Sequence
  Description of Artificial Sequence: Synthetic peptide
AYHYSKGLDY

SEQ ID NO: 107 - protein, 5 aa, Artificial Sequence
  Description of Artificial Sequence: Synthetic peptide
DYAIS

SEQ ID NO: 108 - protein, 17 aa, Artificial Sequence
  Description of Artificial Sequence: Synthetic peptide
RIDPIEGTANYAQKFQG

SEQ ID NO: 109 - protein, 17 aa, Artificial Sequence
  Description of Artificial Sequence: Synthetic peptide
DRYYYDGVYWYSDYFDY

SEQ ID NO: 110 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGWISPYNGNANYAQKFQGRVTITADESTSTAYMELSSLRSEDTAVYYCARVNSAALVWERLDYWGQGTLVTVSS

SEQ ID NO: 111 - protein, 107 aa, Artificial Sequence
  Description of Artificial Sequence: Synthetic polypeptide
DIQMTQSPSSLSASVGDRVTITCRASQSIDRWLNWYQQKPGKAPKLLIYAASSLQSGVPSRFSGSGSGTDFTLTISSLQPEDFATYYCQQSPRYPLTFGQGTKVEIK

SEQ ID NO: 112 - protein, 119 aa, Artificial Sequence
  Description of Artificial Sequence: Synthetic polypeptide
QVQLVQSGAEVKKPGSSVKVSCKASGGTFKSYDISWVRQAPGQGLEWMGGIIPIEGTANYAQKFQGRVTITADESTSTAYMELSSLRSEDTAVYYCARDYPAGYGFDYWGQGTLVTVSS

SEQ ID NO: 113 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 114 - protein, 125 aa, Artificial Sequence
  Description of Artificial Sequence: Synthetic polypeptide
EVQLLESGGGLVQPGGSLRLSCAASGFTFDSDWMSWVRQAPGKGLEWVSAISGNGGSTEYADSVKGRFTISRDNSKNTLYLQMNSLRAEDTAVYYCARDPYYYYDGDSYYGMDVWGQGTLVTVSS

SEQ ID NO: 115 - protein, 107 aa, Artificial Sequence [sequence omitted]

SEQ ID NO: 116 - protein, 124 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSVKGRFTISRDNSKNTLYLQMNSLRAEDTAVYYCARDSYDSSLYVGDYFDYWGQGTLVTVSS

SEQ ID NO: 117 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIK

SEQ ID NO: 118 - protein, 125 aa, Artificial Sequence
  Description of Artificial Sequence: Synthetic polypeptide
QVQLVQSGAEVKKPGSSVKVSCKASGGTFDDYAISWVRQAPGQGLEWMGRIDPIEGTANYAQKFQGRVTITADESTSTAYMELSSLRSEDTAVYYCARDRYYYDGVYWYSDYFDYWGQGTLVTVS

SEQ ID NO: 119 - protein, 107 aa, Artificial Sequence [sequence omitted]

SEQ ID NO: 120 - protein, 122 aa, Artificial Sequence
  Description of Artificial Sequence: Synthetic polypeptide
EVQLVQSGAEVKKPGESLKISCKGSGYSFTSYWISWVRQMPGKGLEWMGIIYPGDSYTRYSPSFQGQVTISADKSISTAYLQWSSLKASDTAMYYCARDYEWELFDSRLDYWGQGTLVTVSS

SEQ ID NO: 121 - protein, 119 aa, Artificial Sequence
  Description of Artificial Sequence: Synthetic polypeptide
QVQLVQSGAEVKKPGSSVKVSCKASGGTFSSYAISWVRQAPGQGLEWMGWISPYNGNANYAQKFQGRVTITADESTSTAYMELSSLRSEDTAVYYCARDSDRSYNLDYWGQGTLVTVSS

SEQ ID NO: 122 - protein, 107 aa, Artificial Sequence
  Description of Artificial Sequence: Synthetic polypeptide
DIQMTQSPSSLSASVGDRVTITCRASQSISGWLNWYQQKPGKAPKLLIYAASSLQSGVPSRFSGSGSGTDFTLTISSLQPEDFATYYCQQSYSTPLTFGQGTKVEIK

SEQ ID NO: 123 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGLPIWYLDYWGQGTLVTVSSA

SEQ ID NO: 124 - protein, 107 aa, Artificial Sequence
  Description of Artificial Sequence: Synthetic polypeptide
EIVLTQSPATLSLSPGERATLSCRASQSVASDLAWYQQKPGQAPRLLIYFASNRATGIPARFSGSGSGTDFTLTISSLEPEDFAVYYCQQSITWPFTFGQGTKVEIK

SEQ ID NO: 125 - protein, 122 aa, Artificial Sequence
  Description of Artificial Sequence: Synthetic polypeptide
QVQLVQSGAEVKKPGSSVKVSCKASGGTFSSYAISWVRQAPGQGLEWMGWIIPYNGNANYAQKFQGRVTITADESTSTAYMELSSLRSEDTAVYYCARVNSAALVWERLDYWGQGTLVTVSS

SEQ ID NO: 126 - protein, 123 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARASRVWHASYGYLDYWGQGTLVTVSS

SEQ ID NO: 127 - protein, 107 aa, Artificial Sequence
  Description of Artificial Sequence: Synthetic polypeptide
EIVLTQSPATLSLSPGERATLSCRASQSVSKWLAWYQQKPGQAPRLLIYDASNRATGIPARFSGSGSGTDFTLTISSLEPEDFAVYYCQQRFTAPWTFGQGTKVEIK

SEQ ID NO: 128 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGWAYDRGLDYWGQGTLVTVSS

SEQ ID NO: 129 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIK

SEQ ID NO: 130 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARAYHYSKGLDYWGQGTLVTVSS

SEQ ID NO: 131 - protein, 113 aa, Artificial Sequence; identical to SEQ ID NO: 129
  Description of Artificial Sequence: Synthetic polypeptide

SEQ ID NO: 132 - protein, 449 aa, Artificial Sequence
  Description of Artificial Sequence: Synthetic polypeptide
QVQLVQSGAEVKKPGSSVKVSCKASGGTFSSYAISWVRQAPGQGLEWMGWISPYNGNANYAQKFQGRVTITADESTSTAYMELSSLRSEDTAVYYCARVNSAALVWERLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 133 - protein, 214 aa, Artificial Sequence
  Description of Artificial Sequence: Synthetic polypeptide
DIQMTQSPSSLSASVGDRVTITCRASQSIDRWLNWYQQKPGKAPKLLIYAASSLQSGVPSRFSGSGSGTDFTLTISSLQPEDFATYYCQQSPRYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 134 - protein, 446 aa, Artificial Sequence
  Description of Artificial Sequence: Synthetic polypeptide
QVQLVQSGAEVKKPGSSVKVSCKASGGTFKSYDISWVRQAPGQGLEWMGGIIPIEGTANYAQKFQGRVTITADESTSTAYMELSSLRSEDTAVYYCARDYPAGYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 135 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - protein, 452 aa, Artificial Sequence
  Description of Artificial Sequence: Synthetic polypeptide
EVQLLESGGGLVQPGGSLRLSCAASGFTFDSDWMSWVRQAPGKGLEWVSAISGNGGSTEYADSVKGRFTISRDNSKNTLYLQMNSLRAEDTAVYYCARDPYYYYDGDSYYGMDVWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 137 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 451 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSVKGRFTISRDNSKNTLYLQMNSLRAEDTAVYYCARDSYDSSLYVGDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 139 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 140 - protein, 453 aa, Artificial Sequence
  Description of Artificial Sequence: Synthetic polypeptide
QVQLVQSGAEVKKPGSSVKVSCKASGGTFDDYAISWVRQAPGQGLEWMGRIDPIEGTANYAQKFQGRVTITADESTSTAYMELSSLRSEDTAVYYCARDRYYYDGVYWYSDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 141 - protein, 446 aa, Artificial Sequence
  Description of Artificial Sequence: Synthetic polypeptide
QVQLVQSGAEVKKPGSSVKVSCKASGGTFSSYAISWVRQAPGQGLEWMGWISPYNGNANYAQKFQGRVTITADESTSTAYMELSSLRSEDTAVYYCARDSDRSYNLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 142 - protein, 214 aa, Artificial Sequence
  Description of Artificial Sequence: Synthetic polypeptide
DIQMTQSPSSLSASVGDRVTITCRASQSISGWLNWYQQKPGKAPKLLIYAASSLQSGVPSRFSGSGSGTDFTLTISSLQPEDFATYYCQQSYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 143 - protein, 445 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGLPIWYLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 144 - protein, 214 aa, Artificial Sequence
  Description of Artificial Sequence: Synthetic polypeptide
EIVLTQSPATLSLSPGERATLSCRASQSVASDLAWYQQKPGQAPRLLIYFASNRATGIPARFSGSGSGTDFTLTISSLEPEDFAVYYCQQSITWPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 145 - protein, 449 aa, Artificial Sequence
  Description of Artificial Sequence: Synthetic polypeptide
QVQLVQSGAEVKKPGSSVKVSCKASGGTFSSYAISWVRQAPGQGLEWMGWIIPYNGNANYAQKFQGRVTITADESTSTAYMELSSLRSEDTAVYYCARVNSAALVWERLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 146 - protein, 450 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARASRVWHASYGYLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 147 - protein, 214 aa, Artificial Sequence
  Description of Artificial Sequence: Synthetic polypeptide
EIVLTQSPATLSLSPGERATLSCRASQSVSKWLAWYQQKPGQAPRLLIYDASNRATGIPARFSGSGSGTDFTLTISSLEPEDFAVYYCQQRFTAPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 148 - protein, 446 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGWAYDRGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 149 - protein, 220 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 150 - protein, 446 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARAYHYSKGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 151 - protein, 449 aa, Artificial Sequence
  Description of Artificial Sequence: Synthetic polypeptide
EVQLVQSGAEVKKPGESLKISCKGSGYSFTSYWISWVRQMPGKGLEWMGIIYPGDSYTRYSPSFQGQVTISADKSISTAYLQWSSLKASDTAMYYCARDYEWELFDSRLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 152 - protein, 8 aa, Artificial Sequence
  Description of Artificial Sequence: Synthetic peptide
GYSFTSYW

SEQ ID NO: 153 - protein, 8 aa, Artificial Sequence
  Description of Artificial Sequence: Synthetic peptide
IYPSDSYT

SEQ ID NO: 154 - protein, 14 aa, Artificial Sequence
  Description of Artificial Sequence: Synthetic peptide
ARRNSAENYADLDY

SEQ ID NO: 155 - protein, 6 aa, Artificial Sequence
  Description of Artificial Sequence: Synthetic peptide
QSISND

SEQ ID NO: 156 - protein, 3 aa, Artificial Sequence
  Description of Artificial Sequence: Synthetic peptide
YAS

SEQ ID NO: 157 - protein, 9 aa, Artificial Sequence
  Description of Artificial Sequence: Synthetic peptide
QQSFTAPLT

SEQ ID NO: 158 - protein, 8 aa, Artificial Sequence
  Description of Artificial Sequence: Synthetic peptide
GFTFSNYA

SEQ ID NO: 159 - protein, 8 aa, Artificial Sequence
  Description of Artificial Sequence: Synthetic peptide
INYGGGSK

SEQ ID NO: 160 - protein, 11 aa, Artificial Sequence
  Description of Artificial Sequence: Synthetic peptide
AKDYGPFALDY

SEQ ID NO: 161 - protein, 6 aa, Artificial Sequence
  Description of Artificial Sequence: Synthetic peptide
QSVDDW

SEQ ID NO: 162 - protein, 3 aa, Artificial Sequence
  Description of Artificial Sequence: Synthetic peptide
TAS

SEQ ID NO: 163 - protein, 9 aa, Artificial Sequence
  Description of Artificial Sequence: Synthetic peptide
QQYHHWPLT

SEQ ID NO: 164 - protein, 10 aa, Artificial Sequence
  Description of Artificial Sequence: Synthetic peptide
GGSISSSTYY

SEQ ID NO: 165 - protein, 7 aa, Artificial Sequence
  Description of Artificial Sequence: Synthetic peptide
IYFTGST

SEQ ID NO: 166 - protein, 14 aa, Artificial Sequence
  Description of Artificial Sequence: Synthetic peptide
AKEDDSSGYYSFDY

SEQ ID NO: 167 - protein, 6 aa, Artificial Sequence
  Description of Artificial Sequence: Synthetic peptide
QGISSY

SEQ ID NO: 168 - protein, 3 aa, Artificial Sequence
  Description of Artificial Sequence: Synthetic peptide
AAS

SEQ ID NO: 169 - protein, 9 aa, Artificial Sequence
  Description of Artificial Sequence: Synthetic peptide
QQVNSYPLT

SEQ ID NO: 170 - protein, 10 aa, Artificial Sequence
  Description of Artificial Sequence: Synthetic peptide
GVSISSSTYY

SEQ ID NO: 171 - protein, 7 aa, Artificial Sequence
  Description of Artificial Sequence: Synthetic peptide
IYFTGNT

SEQ ID NO: 172 - protein, 12 aa, Artificial Sequence
  Description of Artificial Sequence: Synthetic peptide
GSLFGDYGYFDY

SEQ ID NO: 173 - protein, 6 aa, Artificial Sequence
  Description of Artificial Sequence: Synthetic peptide
QFISSN

SEQ ID NO: 174 - protein, 3 aa, Artificial Sequence
  Description of Artificial Sequence: Synthetic peptide
GAS

SEQ ID NO: 175 - protein, 9 aa, Artificial Sequence
  Description of Artificial Sequence: Synthetic peptide
QQYNNWPST

SEQ ID NO: 176 - protein, 8 aa, Artificial Sequence
  Description of Artificial Sequence: Synthetic peptide
GYTFNTYA

SEQ ID NO: 177 - protein, 8 aa, Artificial Sequence
  Description of Artificial Sequence: Synthetic peptide
INTNTGNP

SEQ ID NO: 178 - protein, 14 aa, Artificial Sequence
  Description of Artificial Sequence: Synthetic peptide
ARRYFDWLLGAFDI

SEQ ID NO: 179 - protein, 6 aa, Artificial Sequence
  Description of Artificial Sequence: Synthetic peptide
QGISSW

SEQ ID NO: 180 - protein, 9 aa, Artificial Sequence
  Description of Artificial Sequence: Synthetic peptide
QQANSFPLT

SEQ ID NO: 181 - protein, 8 aa, Artificial Sequence
  Description of Artificial Sequence: Synthetic peptide
GGTFSSYA

SEQ ID NO: 182 - protein, 8 aa, Artificial Sequence
  Description of Artificial Sequence: Synthetic peptide
ISAIFGTA

SEQ ID NO: 183 - protein, 16 aa, Artificial Sequence
  Description of Artificial Sequence: Synthetic peptide
ARGNSFHALWDYAFDY

SEQ ID NO: 184 - protein, 12 aa, Artificial Sequence
  Description of Artificial Sequence: Synthetic peptide
QSVLYSSNNKNY

SEQ ID NO: 185 - protein, 3 aa, Artificial Sequence
  Description of Artificial Sequence: Synthetic peptide
WAS

SEQ ID NO: 186 - protein, 9 aa, Artificial Sequence
  Description of Artificial Sequence: Synthetic peptide
QQYYSTPLT

SEQ ID NO: 187 - protein, 8 aa, Artificial Sequence
  Description of Artificial Sequence: Synthetic peptide
IIPIFGNA

SEQ ID NO: 188 - protein, 15 aa, Artificial Sequence
  Description of Artificial Sequence: Synthetic peptide
ARTIIYLDYVHILDY

SEQ ID NO: 189 - protein, 8 aa, Artificial Sequence
  Description of Artificial Sequence: Synthetic peptide
GFTFSNYW

SEQ ID NO: 190 - protein, 8 aa, Artificial Sequence
  Description of Artificial Sequence: Synthetic peptide
IRYDGGSK

SEQ ID NO: 191 - protein, 12 aa, Artificial Sequence
  Description of Artificial Sequence: Synthetic peptide
AKDAYPPYSFDY

SEQ ID NO: 192 - protein, 6 aa, Artificial Sequence
  Description of Artificial Sequence: Synthetic peptide
QSVSSY

SEQ ID NO: 193 - protein, 3 aa, Artificial Sequence
  Description of Artificial Sequence: Synthetic peptide
DAS

SEQ ID NO: 194 - protein, 9 aa, Artificial Sequence
  Description of Artificial Sequence: Synthetic peptide
QQRSNWPLT

SEQ ID NO: 195 - protein, 8 aa, Artificial Sequence
  Description of Artificial Sequence: Synthetic peptide
GFTFSSYA

SEQ ID NO: 196 - protein, 8 aa, Artificial Sequence
  Description of Artificial Sequence: Synthetic peptide
ISGSGGST

SEQ ID NO: 197 - protein, 14 aa, Artificial Sequence
  Description of Artificial Sequence: Synthetic peptide
AKGDEYYYPDPLDY

SEQ ID NO: 198 - protein, 6 aa, Artificial Sequence
  Description of Artificial Sequence: Synthetic peptide
QSISSY

SEQ ID NO: 199 - protein, 9 aa, Artificial Sequence
  Description of Artificial Sequence: Synthetic peptide
QQSYSTPLT

SEQ ID NO: 200 - protein, 12 aa, Artificial Sequence
  Description of Artificial Sequence: Synthetic peptide
AKEWSSYFGLDY

SEQ ID NO: 201 - protein, 8 aa, Artificial Sequence
  Description of Artificial Sequence: Synthetic peptide
ISPIFGTA

SEQ ID NO: 202 - protein, 15 aa, Artificial Sequence
  Description of Artificial Sequence: Synthetic peptide
ARRYDNFARSGDLDY

SEQ ID NO: 203 - protein, 9 aa, Artificial Sequence
  Description of Artificial Sequence: Synthetic peptide
QQYNNWPFT

SEQ ID NO: 204 - protein, 9 aa, Artificial Sequence
  Description of Artificial Sequence: Synthetic peptide
SSDVGDYNY

SEQ ID NO: 205 - protein, 3 aa, Artificial Sequence
  Description of Artificial Sequence: Synthetic peptide
DVS

SEQ ID NO: 206 - protein, 10 aa, Artificial Sequence
  Description of Artificial Sequence: Synthetic peptide
ASYAGNYNVV

SEQ ID NO: 207 - protein, 10 aa, Artificial Sequence
  Description of Artificial Sequence: Synthetic peptide
SSYAGNYNVV

SEQ ID NO: 208 - protein, 12 aa, Artificial Sequence
  Description of Artificial Sequence: Synthetic peptide
ARHLHNAIHLDY

SEQ ID NO: 209 - protein, 6 aa, Artificial Sequence
  Description of Artificial Sequence: Synthetic peptide
QSVSNF

SEQ ID NO: 210 - protein, 9 aa, Artificial Sequence
  Description of Artificial Sequence: Synthetic peptide
QQGKHWPWT

SEQ ID NO: 211 - protein, 448 aa, Artificial Sequence
  Description of Artificial Sequence: Synthetic polypeptide
EVQLVQSGAEVKKPGESLKISCKGSGYSFTSYWIGWVRQMPGKGLEWMGIIYPSDSYTRYSPSFQGQVTISADKSISTAYLQWSSLKASDTAMYYCARRNSAENYADLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 212 - protein, 214 aa, Artificial Sequence
  Description of Artificial Sequence: Synthetic polypeptide
EIVLTQSPGTLSLSPGERATLSCRASQSISNDLNWYQQKPGKAPKLLIYYASSLQSGVPSRFSGSGSGTDFTLTINSLQPEDFATYYCQQSFTAPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 213 - protein, 445 aa, Artificial Sequence
  Description of Artificial Sequence: Synthetic polypeptide
EVQLLESGGGLVQPGGSLRLSCAASGFTFSNYAMNWVRQAPGKGLEWVSGINYGGGSKYYADSVKGRFTISRDNSKNTLYLQMNSLRAEDTAVYYCAKDYGPFALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 214 - protein, 214 aa, Artificial Sequence
  Description of Artificial Sequence: Synthetic polypeptide
EIVLTQSPATLSLSPGERATLSCRASQSVDDWLAWYQQKPGQAPRLLIYTASNRATGIPARFSGSGSGTDFTLTISSLEPEDFAVYYCQQYHHWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 215 - protein, 449 aa, Artificial Sequence
  Description of Artificial Sequence: Synthetic polypeptide
QLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 216 - protein, 214 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 217 - protein, 448 aa, Artificial Sequence
  Description of Artificial Sequence: Synthetic polypeptide
QLQLQESGPGLVKPSETLSLTCTVSGVSISSSTYYWGWLRQPPGMGLEWTGSIYFTGNTYYNPSLKSRVTISVDTSRNQFSLKLSSVTAADTAVYYCGSLFGDYGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEVVESNGQPENNYKTTPPVLDSDGSFFLYSRLTVDKSRWQEGNVFSCSVMHEALHNHYTQKSLSLSLGK

SEQ ID NO: 218 - protein, 214 aa, Artificial Sequence
  Description of Artificial Sequence: Synthetic polypeptide
EIVMTQSPATLSVPPGERATLSCRASQFISSNLAWYQQKPGQAPRLLIYGASTRATGIPARFSGSGSGTDFTLTISSLQSEDFAVYYCQQYNNWPSTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 219 - protein, 448 aa, Artificial Sequence
  Description of Artificial Sequence: Synthetic polypeptide
QVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 220 - protein, 214 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 221 - protein, 450 aa, Artificial Sequence
  Description of Artificial Sequence: Synthetic polypeptide
QVQLVQSGAEVKKPGSSVKVSCKASGGTFSSYAISWVRQAPGQGLEWMGGISAIFGTANYAQKFQGRVTITADESTSTAYMELSSLRSEDTAVYYCARGNSFHALWDYAFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 222 - protein, 220 aa, Artificial Sequence; identical to SEQ ID NO: 149
  Description of Artificial Sequence: Synthetic polypeptide

SEQ ID NO: 223 - protein, 449 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGNANYAQKFQGRVTITADESTSTAYMELSSLRSEDTAVYYCARTIIYLDYVHILDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 224 - protein, 446 aa, Artificial Sequence
  Description of Artificial Sequence: Synthetic polypeptide
EVQLLESGGGLVQPGGSLRLSCAASGFTFSNYWMNWVRQAPGKGLEWVSAIRYDGGSKYYADSVKGRFTISRDNSKNTLYLQMNSLRAEDTAVYYCAKDAYPPYSFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 225 - protein, 214 aa, Artificial Sequence; identical to SEQ ID NO: 139
  Description of Artificial Sequence: Synthetic polypeptide

SEQ ID NO: 226 - protein, 448 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGDEYYYPDPLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVYSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 227 - protein, 214 aa, Artificial Sequence; identical to SEQ ID NO: 137
  Description of Artificial Sequence: Synthetic polypeptide

SEQ ID NO: 228 - protein, 446 aa, Artificial Sequence
  Description of Artificial Sequence: Synthetic polypeptide
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCAKEWSSYFGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 229 - protein, 449 aa, Artificial Sequence
  Description of Artificial Sequence: Synthetic polypeptide
QVQLVQSGAEVKKPGSSVKVSCKASGGTFSSYAISWVRQAPGQGLEWMGWISPIFGTANYAQKFQGRVTITADESTSTAYMELSSLRSEDTAVYYCARRYDNFARSGDLDYWGQGTLVTVSSASTKGPSVFPLAPCSRSTSESTAALGCLVKDYFPEPYTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 230 - protein, 214 aa, Artificial Sequence
  Description of Artificial Sequence: Synthetic polypeptide
EIVMTQSPATLSVSPGERATLSCRASQFISSNLAWYQQKPGQAPRLLIYGASTRATGIPARFSGSGSGTDFTLTISSLQSEDFAVYYCQQYNNWPFTFGPGHCVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 231 - protein, 216 aa, Artificial Sequence
  Description of Artificial Sequence: Synthetic polypeptide
QSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 232 - protein, 216 aa, Artificial Sequence
  Description of Artificial Sequence: Synthetic polypeptide
QSALTQPRSVSGSPGHSVTISCTGTSSDVGDYNYVSWYQQRPGKVPKLLIYDVSKRPSGVPDRFSGSKSGNTASLTISGLQAEDEAIYFCSSYAGNYNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 233 - protein, 446 aa, Artificial Sequence
  Description of Artificial Sequence: Synthetic polypeptide
QVQLVQSGAEVKKPGSSVKVSCKASGGTFSSYAISWVRQAPGQGLEWMGGISAIFGTANYAQKFQGRVTITADESTSTAYMELSSLRSEDTAVYYCARHLHNAIHLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDLAVEWESNGQPENNYKTTPPVLDSDGSFFLYSRLTVDKSRWQEGNVFSCSVMHEALHNHYTQKSLSLSLGK

SEQ ID NO: 234 - protein, 214 aa, Artificial Sequence
  Description of Artificial Sequence: Synthetic polypeptide
EIVLTQSPATLSLSPGERATLSCRASQSVSNFLAWYQQKPGQAPRLLIYGASNRATGIPARFSGSGSGTDFTLTISSLEPEDFAVYYCQQGKHWPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 235-245 - skipped (11 entries)

SEQ ID NO: 246 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSS

SEQ ID NO: 247 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCARHGNFGNSYVSWFAYWGQGTLVTVSS

SEQ ID NO: 248 - protein, 125 aa, Artificial Sequence
  Description of Artificial Sequence: Synthetic polypeptide
QLQLQESGPGLVNPSETLSHTCTVSGGSISSSSHYWGWIRQPPGKGLEWIGKIYYSGNTYYNPSLKSRVTISIDTSKNQFSLKMSSVTAADTAVYYCARLADVVVVPAARYFDSWGQGTLVTVSS

SEQ ID NO: 249 - protein, 122 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVRSRITINPDTSKNQFSLQLNSVTPEDTAVYHCARETMFRGLMDYWGQGTLVTVSS

SEQ ID NO: 250 - protein, 129 aa, Artificial Sequence
  Description of Artificial Sequence: Synthetic polypeptide
QVQLVESGGGVVQPGRSLRLSCAASGFTFSSYGMHWVRQSPGKGLEWVAVISYDGSNKYCADSVKGRFTISRDNSKSTLYLQMNSLRAEDTAVYYCAKDFRSLDWLPPDSTSYDGMDVWGQGTTVTVSS

SEQ ID NO: 251 - protein, 116 aa, Artificial Sequence
  Description of Artificial Sequence: Synthetic polypeptide
QVQLVQSGSELKKPGASVKVSCKASGYTFTNYAMNWVRQAPGQGLEWMGWINTNTGNPTYAQAFTGRFVFSLDTSVSTAYLQISSLKAEDTAVYYCARDREVRDYWGQGTLVTVSS

SEQ ID NO: 252 - protein, 125 aa, Artificial Sequence
  Description of Artificial Sequence: Synthetic polypeptide
QLQLQESGPGLVKPSETLSLTCTVSGGSIRSTNYYWGWIRQPPGKGLEWIGTIYYSGNTYYNPSLKSRVTISVDTSKNQFSLKLSSVTAADTAVYYCARLADVVVVPAARYFDYWGQGILVTVSS

SEQ ID NO: 253 - protein, 125 aa, Artificial Sequence
  Description of Artificial Sequence: Synthetic polypeptide
QLQLQESGPGLVKPSETLSLTCTVSGGSIRSSGFYWGWIRQPPRKGLEWIGTIYYSGNTYYNPSLKSRVTISVDTSKNQFSLKLSSVTAADTAVYFCARLADVVVVPAARYFDNWGQGTLVTVSS

SEQ ID NO: 254 - protein, 125 aa, Artificial Sequence
  Description of Artificial Sequence: Synthetic polypeptide
QLQLQESGPGLVKPSETLSLTCTVSGGSISTGRYYWGWIRQPPGKGVIWIGNIYYSGNTYYNPSLKSRVTISVDTSKNQFSLKLNSVTAADTAVYYCARLGSLVVVPAAMSFDYWGQGTLVTVSS

SEQ ID NO: 255 - protein, 125 aa, Artificial Sequence
  Description of Artificial Sequence: Synthetic polypeptide
QLQLQESGPGLVKPSETLSLTCTVSGGSIRGSSYYWGWVRQPPGKGLEWIGSIYSSGNTYYNPSLKSRVTISVDTSKNQFSLKLSSVTAADTALYYCARLGSLVVVPAAMSFDYWGQGTLVTVSS

SEQ ID NO: 256 - protein, 119 aa, Artificial Sequence
  Description of Artificial Sequence: Synthetic polypeptide
QVQLQESGPGLVKPSGTLSLTCAVSGGSISSSNWWSWVRQPPGRGLEWIGEIYHSGNTNNSPSLKSRVTISADKSKNQFSLKLSSVTAADTAVYFCARIIAVARYFDSWGQGTLVTVSS

SEQ ID NO: 257 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVVVISYDGSNKYYADSVKGRFTISRDNSKNTLYLQMNSLRAEDTAVYYCAKDFRDFDWLPPDSTSYHGMDVWGQGTTVTVSS

SEQ ID NO: 258 - protein, 129 aa, Artificial Sequence
  Description of Artificial Sequence: Synthetic polypeptide
QVQLVESGGGVVQPGRSLRLSCVASGFTFSSYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSS

SEQ ID NO: 259 - protein, 120 aa, Artificial Sequence
  Description of Artificial Sequence: Synthetic polypeptide
EVQLLESGGGLVQPGGSLGLSCAASGFTFSGYAMSWVRQAPGKGLNWVSAIDYSGNDTYYADSVKGRFTISRDNSKNTLYLQMNSLRAEDTAVYYCAKESQLLHGLFEHWGQGILVTVSS

SEQ ID NO: 260 - skipped

SEQ ID NO: 261 - protein, 125 aa, Artificial Sequence
  Description of Artificial Sequence: Synthetic polypeptide
QLQLQESGPGLVKPSETLSLTCTVSGGSIRGSSYYWGWIRQPPGKGLEWIGSIYSSGNTYYNPSLKSRVTISVDTSKNQFSLKLSSVTAADTAVYYCARLGSLVVVPAAMSFDYWGQGTLVTVSS

SEQ ID NO: 262 - protein, 118 aa, Artificial Sequence
  Description of Artificial Sequence: Synthetic polypeptide
EVQLVESGGGLVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSS

SEQ ID NO: 263 - protein, 119 aa, Artificial Sequence
  Description of Artificial Sequence: Synthetic polypeptide
EVQLLESGGGLVQPGGSLRLSCAASRFTFSSYAMTWVRQAPGKGLEWVSTINISGGSTYYADSVKGRFTISRDNSKNTLYLQMNSLRAEDTAVYYCTKGGYSSGPFDYWGQGTLVSVSS

SEQ ID NO: 264 - protein, 129 aa, Artificial Sequence
  Description of Artificial Sequence: Synthetic polypeptide
QVQLVESGGGVVQPGRSLRLSCAASRFTFSSYGMHWVRQAPGKGLEWVAVISYDGSNKYYADSVKGRFTISRDNSKNTLYLQMNSLRAEDTAVHYCAKDFRSFDWLPPDSASYHGMDVWGQGTTVTVSS

SEQ ID NO: 265 - protein, 121 aa, Artificial Sequence
  Description of Artificial Sequence: Synthetic polypeptide
EVQLLESGGGLVQPGGSLRLSCAASGFTFNYAMSWVRQAPGKGLEWVSAISGSGGSTYYADSVKGRFTISRDISKNTLYLQMNSLRAEDTAVYYCARTYNSGYYDGDFDYWGQGTLVTVSS

SEQ ID NO: 266 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLFLQMNSLRAEDTAVYYCAKDFRYFDWLPPDSSSYYGMDVWGQGTTVTVSS

SEQ ID NO: 267 - protein, 117 aa, Artificial Sequence
  Description of Artificial Sequence: Synthetic polypeptide
QVQLVQSGSELRKPGASVKVSCKASGYTFTNYAMNWVRQAPGQGLEWMGWINTNTGNPTYAQGFTGRFVFSLDTSVSSAYLQISSLKAEDTAMYYCATDRDRGTDYWGQGTLVTVSS

SEQ ID NO: 268 - protein, 129 aa, Artificial Sequence
  Description of Artificial Sequence: Synthetic polypeptide
QVQLVESGGGVVQPGRSLRLSCAASGFTFSAYGMHWVRQAPGKGLEWVAVISYDGSNKYYADSVKGRFTISRDNSKNTLYLQMNSLRAEGTAVYYCAKDFRSFDWLPPDSASYHGMDVWGQGTTVTVSS

SEQ ID NO: 269 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDFRSFDWLPPDSTSYYGMDVWGQGTTVTVSS

SEQ ID NO: 270 - protein, 118 aa, Artificial Sequence
  Description of Artificial Sequence: Synthetic polypeptide
EVQLVESGGGFVQPGGSLRLSCAASGFTFSSYWMSWVRQAPGKGLEWVANIKQHGSEKYYVDSVKGRFTISRDNVKNSLYLQMNSLRTEDTAVYYCARDRDLGYFDYWGQGTLVTVSS

SEQ ID NO: 271 - protein, 119 aa, Artificial Sequence
  Description of Artificial Sequence: Synthetic polypeptide
QVQLVQSGSELKKPGASVKVSCKASGYTLTRSAMNWVRQAPGQGLEWMGWINTNTGNPTYAQGFTGRFVFSLDTSVNTAYLLISSLKTEDTAVYYCASDILPGYHEDYWGQGTLVTVSS

SEQ ID NO: 272 - protein, 122 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYALSVQSRITINPDTSKNQFSLQLNSVTPEDTAVYYCAREVAVAASFDYWGQGTLVTVSS

SEQ ID NO: 273 - protein, 125 aa, Artificial Sequence
  Description of Artificial Sequence: Synthetic polypeptide
QLQLQESGPGLVKPSETLSLTCTVSGGSISSRSHYWGWIRQPPGVGLEWIGSIYYTGSTYYNPSLKSRVTISVDTSKNQFSLKLSSVTAADTAVYYCARLADIVVVPAARYFDYWGQGTLVTVSS

SEQ ID NO: 274 - protein, 125 aa, Artificial Sequence
  Description of Artificial Sequence: Synthetic polypeptide
QLQLQESGPGLVKPSETLSLTCTVSGGSIRSSSYYWGWIRQPPGKGPEWIGSIYSSGNTYYNPSLKSRVTISVDTSKNQFSLKLISMTAADTAVFYCARLAATIVVPAARYFDCWGQGTLVTVSS

SEQ ID NO: 275 - protein, 118 aa, Artificial Sequence
  Description of Artificial Sequence: Synthetic polypeptide
EVQLVESGGGFVQPGGSLRLSCAASGFTFSSYWMSWVRQAPGKGLEWVANIKQHGSEKYYVDSVKGRFTISRDNAKNSLYLQMNSLRAEDTAVYYCARDRDLGYFDYWGQGTLVTVSS

SEQ ID NO: 276 - protein, 117 aa, Artificial Sequence
  Description of Artificial Sequence: Synthetic polypeptide
EVQLVESGGGLVQPGGSLRLSCAASGFTFSSYWMTWVRPAPGKGLEWVANIKRDGGEKYYVDSVKGRFTISRDNAANSLYLQMNSLRVEDTAVYYCARPFYDHFDYWGQGTLVTVSS

SEQ ID NO: 277 - protein, 117 aa, Artificial Sequence
  Description of Artificial Sequence: Synthetic polypeptide
QVQLVQSGSELKKPGASVKVSCKASGYTFSTYAMNWVRQAPGQGLEWMGWINTNTGNPTYAQGFTGRFVFSLDTSVSTAYLQISSLKAEDTAVYYCARDRDRGTDYWGQGTLVTVSS

SEQ ID NO: 278 - protein, 119 aa, Artificial Sequence
  Description of Artificial Sequence: Synthetic polypeptide
EVQLVESGGGLVQPGRSLRLSCVASGFTFDDYAIHWVRQAPGKGLEWVSGLSWNGGNIGYADSVKGRFTISRDNAKNSLYLQMNSLKTEDTAFYYCTKDTPYGDYFDYWGQGTLVTVSS

SEQ ID NO: 279 - protein, 119 aa, Artificial Sequence
  Description of Artificial Sequence: Synthetic polypeptide
EVQLVESGGGLVQPGRSLRLSCAGSGFTFDDYAIHWVRQAPGKGLEWVSGLSWNGGNIGYADSVKGRFTISRDNAKNSLYLQLNSLKTEDTAFYYCAKDSPYGDYFDYWGQGTLVTVSS

SEQ ID NO: 280 - protein, 119 aa, Artificial Sequence
  Description of Artificial Sequence: Synthetic polypeptide
EVQLVESGGGLVQPGRSLRLSCAASGFTFDDYAMHWVRQAPGKGLEWVSGIGWSGGSIVYADSVKGRFKISRDNAKNSLYLQMNSLRAEDTALYYCAKDSPYGDFFDYWGQGTLVTVSS

SEQ ID NO: 281 - protein, 119 aa, Artificial Sequence
  Description of Artificial Sequence: Synthetic polypeptide
EVQLVESGGGLVQPGRSLRLSCAASGFTFDDYAMHWVRQAPGKGLEWVSGIGWSGGSIVYADSVKGRFTISRDNAKNSLYLQMNSLRAEDTALYYCAKDSPYGDFFDYWGQGTLVTVSS

SEQ ID NO: 282 - protein, 120 aa, Artificial Sequence
  Description of Artificial Sequence: Synthetic polypeptide
EVQLLESGGGLVQPGGSLKLSCTASGFTFRSYAMSWVRQAPGKGLEWVSAINGYGDGRYYADSVKGRFTISRDNSKNTLYLQMNSLRAEDTAVYSCAKDQGFGELFFDYWGQGTLVTVSS

SEQ ID NO: 283 - protein, 117 aa, Artificial Sequence
  Description of Artificial Sequence: Synthetic polypeptide
QVQLVESGGGVVQPGRSLRLSCAASGFTFSYYGMHWVRQAPDKGLEWVAVIWFDGNNKYYADSVKGRFTISRDNSKNTLYLQMNSLRAEDTAVYYCARDRELLFDYWGQGTLVTVSS

SEQ ID NO: 284 - protein, 129 aa, Artificial Sequence
  Description of Artificial Sequence: Synthetic polypeptide
EVQLVESGGGLVQPGRSLRLSCAASGFTFDDYAMHWVRQVPGEGLEWVSGISWNGGDMVYADSVKGRFTISRDNAKNSLYLQMNSLRPEDTALYYCVKDMPYFDFLTGSDYYYYGMDVWGQGTTVTVSS

SEQ ID NO: 285 - protein, 117 aa, Artificial Sequence
  Description of Artificial Sequence: Synthetic polypeptide
QVQLVESGGGVVQPGRSLRLSCATSGFTFSNYGMHWVRQAPGKGLEWVAVIWYVGSHKYYADSVKGRFTISRDNSKNTLYLQMNSLRAEDTAVYYCARDGSLCFDYWGQGTLVTVSS

SEQ ID NO: 286 - protein, 111 aa, Artificial Sequence
  Description of Artificial Sequence: Synthetic polypeptide
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIK

SEQ ID NO: 287 - protein, 109 aa, Artificial Sequence
  Description of Artificial Sequence: Synthetic polypeptide
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 288 - protein, 106 aa, Artificial Sequence
  Description of Artificial Sequence: Synthetic polypeptide
SYELTQPPSVSVSPGQTASIICSGDKLGNKYACWYQQKPGQSPVLVIYQDSKRPSGIPERFSGSNSGNTATLTISGTQAVDEADYYCQAWDSSTYVFGTGTKVTVL

SEQ ID NO: 289 - protein, 107 aa, Artificial Sequence
  Description of Artificial Sequence: Synthetic polypeptide
SYVLTQPPSVSVAPGQTARITCGGSNIGSKSVHWYQQKPGQAPVMVVYDDSDRPSGIPERFSGSNSGNTATLTISRVEAGDEADYYCQVWDSSSDVVFGGGTKLTVL

SEQ ID NO: 290 - protein, 106 aa, Artificial Sequence
  Description of Artificial Sequence: Synthetic polypeptide
SYELTQPPSVSVSPGQTASITCSGHKLGDKYACWYQQKPGQSPVVVIYKDSKRPSGIPERFSGSNFGNTATLTISGTQAMDEADYYCQAWDSSTVVFGGGTKLTVL

SEQ ID NO: 291 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 292 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDYKRPSGIPERFSGSNSGNTATLTISGTQAMDEADYYCQAWDSSTYVFGTGTKVTVL

SEQ ID NO: 293 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDYKRPSGIPERFSGSNSGNTATLTISGTQTMDEADYYCQAWDISTYVFGTGTKVTVL

SEQ ID NO: 294 - protein, 106 aa, Artificial Sequence
  Description of Artificial Sequence: Synthetic polypeptide
SYELTQPPSVSVSPGQTASITCSGDKLGDKYACWYQLRPGQSPILVIYQDSNRPSGIPERFSGSNSGNTATLTISGTQAMDEADYYCQAWDSSTWVFGGGTKLTVL

SEQ ID NO: 295 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDSSTWVFGGGTKLTVL

SEQ ID NO: 296 - protein, 108 aa, Artificial Sequence
  Description of Artificial Sequence: Synthetic polypeptide
SYVLTQPPSVSVAPGQTARITCGGNNIGIKSVHWYQQKPGQAPVLVVYDDSDRPPGIPERFSGSNSGNTATLTITRVEAGDEADYYCQVWDSSSDHVVFGGGTKLTVL

SEQ ID NO: 297 - protein, 106 aa, Artificial Sequence
  Description of Artificial Sequence: Synthetic polypeptide
SYELTQPPSVSVSPGQTASITCSGDKLGDKYACWYQQKPGQSPVVVIYQDRKRPSGIPERFSGSNFGNTATLTISGTQAMDEADYYCQAWDSSTVVFGGGTKLTVL

SEQ ID NO: 298 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDGKRPSGIPERFSGSNFGNKATLTISGTQAMDEADYYCQAWDRNTVVFGGGTKLTVL

SEQ ID NO: 299 - protein, 113 aa, Artificial Sequence
  Description of Artificial Sequence: Synthetic polypeptide
DIVMTQSPDSLAVSLGERATINCKSSQSVLYSSNNKNYLAWYQQKAGQPPKLLIYWASTRESGVPDRFSGSGSGTDFILIISSLQAEDVAVYYCQQYYGTPWTFGQGTKVEIK

SEQ ID NO: 300 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK

SEQ ID NO: 301 - protein, 106 aa, Artificial Sequence
  Description of Artificial Sequence: Synthetic polypeptide
SYELTQPPSVSVSPGQTASITCSGNKLGAKFASWYQQKPGQSPVLVIYQDNKRPSGIPERFSGSNSGNTATLTISGTQAVDEADYYCQAWDSSTVVFGGGTKLTVL

SEQ ID NO: 302 - protein, 107 aa, Artificial Sequence
  Description of Artificial Sequence: Synthetic polypeptide
SYELTQPPSVSVSPGQTASITCSGDKLGDKYVRWYQQKTGQSPVLVMYQDSKRPSGIRERFYGSNSGNTATPTISGTQAVDEAEYYCQAWDSSTGVVFGGGTKLTVL

SEQ ID NO: 303 - protein, 106 aa, Artificial Sequence
  Description of Artificial Sequence: Synthetic polypeptide
SYELTQPPSVSVPPGQTASITCSGDKLGDKYACWYQQKPGQSPVLVIYQDNKRPSGIPERFSGSNSGNTATLTISGTQAMDEADYYCQAWGRNTVVFGGGTKLTVL

SEQ ID NO: 304 - protein, 111 aa, Artificial Sequence
  Description of Artificial Sequence: Synthetic polypeptide
QSALTQPASVSGSPGQSIPISSTGTSSDDGKNNIVSWYQQHPGKAPKLMIYKDSKRPSGVSNRFSGSKSGNTASLTISGLQADDEADYHCCSYAGASNHVVFGGGTKLTVL

SEQ ID NO: 305 - protein, 106 aa, Artificial Sequence
  Description of Artificial Sequence: Synthetic polypeptide
SYELTQPPSVSVSPGQTASITCSGDELGNKYACWYQQKPGQSPVVVVYQDRKRPSGIPERFSGSNFGNTATLTISGTQAMDEADYYCQAWDSSTVVFGGGTKLTVL

SEQ ID NO: 306 - protein, 111 aa, Artificial Sequence
  Description of Artificial Sequence: Synthetic polypeptide
QSALTQPASVSGSPGQSITISCTGTSSDVGDYNYVSWYQQHPGKVPKLMIYDVSNRPSGVSNRFSGSMSGNTASLTISGLQAEDEADYYCSSYSSSSALEVFGGGTKLTVL

SEQ ID NO: 307 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDNKRPSGIPERFSGSNSGNTATLTISGTQAMDEADYYCQAWDSNTVVFGGGTKLTVL

SEQ ID NO: 308 - protein, 106 aa, Artificial Sequence
  Description of Artificial Sequence: Synthetic polypeptide
SYELTQPPSVSVSPGQTASITCSGDKLGDKYVCWYQQKPGQSPVVVIHQDRKRPSGIPERFSGSNFGNTATLTISGTQAMDEADYYCQAWDSSTVVFGGGTKLTVL

SEQ ID NO: 309 - protein, 106 aa, Artificial Sequence
  Description of Artificial Sequence: Synthetic polypeptide
SYELTQPPSVSVSPGQTASITCSGDKLGNKYASWYQQKPGQSPVLVIYQDTKRPSGIPERVSGSNSGNTATLTISGTQAMDEADYHCQAWDSSTVVFGGGTKLTVL

SEQ ID NO: 310 - protein, 111 aa, Artificial Sequence
  Description of Artificial Sequence: Synthetic polypeptide
QSALTQPASVSGSPGQSITISCTGINSDVGSYDLVSWYQQHPGKAPKLLIYDGSERPSGVFGRFSGSKSDNTTSLTISGLQAEDEAAYYCCSYEVTTTYVVFGGGTKLTVL

SEQ ID NO: 311 - protein, 108 aa, Artificial Sequence
  Description of Artificial Sequence: Synthetic polypeptide
SYVLTQPPSVSVAPGQTARITCGGNNIGSKSVHWSQQKPGQAPVLVVYDDSDRPSGIPERFSGSNSGNTATLTISRVEAGDEADYYCQVWDSNSDHVVFGGGTKLTVL

SEQ ID NO: 312 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSNRPSGIPERFSGSNSGNTATLTISETQAMDEADYYCQAWDSSTYVFGTGTKVTVL

SEQ ID NO: 313 - protein, 106 aa, Artificial Sequence
  Description of Artificial Sequence: Synthetic polypeptide
SYELTQPPSVSVSPGQTVSISCSGDRLGDKYACWYQQKPGQSPVLVIYQDSKRPSGIPERFSGSNSGNTATLTISGTQAMDEADYYCQAWDSSSYVFGTGTKVTVL

SEQ ID NO: 314 - protein, 106 aa, Artificial Sequence
  Description of Artificial Sequence: Synthetic polypeptide
SYELTQPPSVSVSPGQTASITCSGDKLGSKFACWYQQKPGQSPVLVIYQDSKRPSGIPERFSGSNSGNTATLTISGTQAMDEADYYCQAWDSSTVVFGGGTKLTVL

SEQ ID NO: 315 - protein, 108 aa, Artificial Sequence
  Description of Artificial Sequence: Synthetic polypeptide
SYVLTQPPSVAVAPGQTARITCGGSNIGKISVHWYQQKAGQAPVLVVHDDRARPSGIPERLSGSNSGTTATLTISRVEVGDEADYYCQVWNSSSVHPVFGGGTKLTVL

SEQ ID NO: 316 - protein, 111 aa, Artificial Sequence
  Description of Artificial Sequence: Synthetic polypeptide
QSALTQPASVSGSPGQSITISCTGTSSDVGDDNYVSWYQQHPGKAPKLMIYDVSNRPSGVSNRFSGSKSGNTASLTISGLQSEDEADYYCSSYSSSTTLEVFGGGTKLTVL

SEQ ID NO: 317 - protein, 107 aa, Artificial Sequence
  Description of Artificial Sequence: Synthetic polypeptide
DIQMTQSPSSVWASVGDRVTITCRASQGISSWLAWYQQQPGKAPNLLIYRSSSLQSGVPSRFSGSGSGTDFTLTISSLQPEDFATYYCQQDNSFPYTFGQGTKLEIK

SEQ ID NO: 318 - protein, 107 aa, Artificial Sequence
  Description of Artificial Sequence: Synthetic polypeptide
DIQMTQSPSSEWASVGDRVTITCRASQGISSWLAWYQQKPGKAPKLLIYGASSWQSGVPSRFSGSGSGTDFTLTISSLQPEDFATYYCQQDNSFPYTFGQGTKLEIK

SEQ ID NO: 319 - protein, 113 aa, Artificial Sequence
  Description of Artificial Sequence: Synthetic polypeptide
DIVMTQSPDSLAVSLGERATINCKSSQTVLYSSNNKNYLAWYQQKPGQPPKLLISWASTRKSGVPDRFSGSGSGTDFTLTVSSLQAEDVAVYYCQHYYSTPYTFGQGTKLEIK

SEQ ID NO: 320 - protein, 113 aa, Artificial Sequence
  Description of Artificial Sequence: Synthetic polypeptide
DIVMTQSPDSLAVSLGERATINCKSSQTVFYSSNNKNYLAWYQQKPGQPPKLLISWASTRKSGVPDRFSGSGSGTDFTLTVSSLQAEDVAVYYCQHYYSTPYTFGQGTKLEIK

SEQ ID NO: 321 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYCCQQYNSYPWTFGQGTKVEIK

SEQ ID NO: 322 - protein, 106 aa, Artificial Sequence
  Description of Artificial Sequence: Synthetic polypeptide
SYELTQPPSVSVSPGQTASITCSGDELGDMYACWYQQKPGQSPLVVIYQDSKRPSGIPERFSGSNSGNTATLTISGTQAMDEAAYYCQTWDTRIAVFGGGTNLTVL

SEQ ID NO: 323 - protein, 106 aa, Artificial Sequence
  Description of Artificial Sequence: Synthetic polypeptide
SYELTQPPSVSVSPGQTASITCSGDNLGNEHVCWYHQKPGQSPVLVIYQNNKRPSGIPERFSGSNSGNTATLSISGTQATDEADYYCQAWDSTTAVFGGGTKLTVL

SEQ ID NO: 324 - protein, 106 aa, Artificial Sequence
  Description of Artificial Sequence: Synthetic polypeptide
SYELTQPPSVSVSPGQTANISCSGVTLGYNYAYWYQQKPGQSPILVISQDTQRPSGIPERFSGSNSGNTATLTISGTQAMDEAAYYCQAWDITTVLFGGGTKLTVL

SEQ ID NO: 325 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDGKRPSGIPERFSGSNFGNKATLTISGTQAMDEADYYCQAWDRNTVVFGGGTKLTVL

SEQ ID NO: 326 - protein, 106 aa, Artificial Sequence
  Description of Artificial Sequence: Synthetic polypeptide
SYELTQPPSVSVSPGQTASITCSGDKLGNKYASWYQQKPGQSPVLVIYQDSKRPSGIPERFSGSNSGNTATLTISGTQAMDEADYYCQAWDSSTVVFGGGTKLTVL

SEQ ID NO: 327 - protein, 10 aa, Artificial Sequence
  Description of Artificial Sequence: Synthetic peptide
GFSLSTSGMG

SEQ ID NO: 328 - protein, 8 aa, Artificial Sequence
  Description of Artificial Sequence: Synthetic peptide
GFTFNTYA

SEQ ID NO: 329 - protein, 10 aa, Artificial Sequence
  Description of Artificial Sequence: Synthetic peptide
GDSVFNNNAA

SEQ ID NO: 330 - protein, 10 aa, Artificial Sequence
  Description of Artificial Sequence: Synthetic peptide
GGSISSSSHY

SEQ ID NO: 331 - protein, 10 aa, Artificial Sequence
  Description of Artificial Sequence: Synthetic peptide
GDSVSSNSAA

SEQ ID NO: 332 - protein, 8 aa, Artificial Sequence
  Description of Artificial Sequence: Synthetic peptide
GFTFSSYG

SEQ ID NO: 333 - protein, 8 aa, Artificial Sequence
  Description of Artificial Sequence: Synthetic peptide
GYTFTNYA

SEQ ID NO: 334 - protein, 10 aa, Artificial Sequence
  Description of Artificial Sequence: Synthetic peptide
GGSIRSTNYY

SEQ ID NO: 335 - protein, 10 aa, Artificial Sequence
  Description of Artificial Sequence: Synthetic peptide
GGSIRSSGFY

SEQ ID NO: 336 - protein, 10 aa, Artificial Sequence
  Description of Artificial Sequence: Synthetic peptide
GGSISTGRYY

SEQ ID NO: 337 - protein, 10 aa, Artificial Sequence
  Description of Artificial Sequence: Synthetic peptide
GGSIRGSSYY

SEQ ID NO: 338 - protein, 9 aa, Artificial Sequence
  Description of Artificial Sequence: Synthetic peptide
GGSISSSNW

SEQ ID NO: 339 - protein, 8 aa, Artificial Sequence
  Description of Artificial Sequence: Synthetic peptide
GFTFSSYG

SEQ ID NO: 340 - protein, 8 aa, Artificial Sequence
  Description of Artificial Sequence: Synthetic peptide
GFTFSSYG

SEQ ID NO: 341 - protein, 8 aa, Artificial Sequence
  Description of Artificial Sequence: Synthetic peptide
GFTFSGYA

SEQ ID NO: 342 - protein, 10 aa, Artificial Sequence
  Description of Artificial Sequence: Synthetic peptide
GGSISSSSYY

SEQ ID NO: 343 - protein, 10 aa, Artificial Sequence
  Description of Artificial Sequence: Synthetic peptide
GGSIRGSSYY

SEQ ID NO: 344 - protein, 8 aa, Artificial Sequence
  Description of Artificial Sequence: Synthetic peptide
GFTFSSYW

SEQ ID NO: 345 - protein, 8 aa, Artificial Sequence
  Description of Artificial Sequence: Synthetic peptide
RFTFSSYA

SEQ ID NO: 346 - protein, 8 aa, Artificial Sequence
  Description of Artificial Sequence: Synthetic peptide
RFTFSSYG

SEQ ID NO: 347 - protein, 7 aa, Artificial Sequence
  Description of Artificial Sequence: Synthetic peptide
GFTFNYA

SEQ ID NO: 348 - protein, 8 aa, Artificial Sequence
  Description of Artificial Sequence: Synthetic peptide
GFTFSSYG

SEQ ID NO: 349 - protein, 8 aa, Artificial Sequence
  Description of Artificial Sequence: Synthetic peptide
GYTFTNYA

SEQ ID NO: 350 - protein, 8 aa, Artificial Sequence
  Description of Artificial Sequence: Synthetic peptide
GFTFSAYG

SEQ ID NO: 351 - protein, 8 aa, Artificial Sequence
  Description of Artificial Sequence: Synthetic peptide
GFTFSSYG

SEQ ID NO: 352 - protein, 8 aa, Artificial Sequence
  Description of Artificial Sequence: Synthetic peptide
GFTFSSYW

SEQ ID NO: 353 - protein, 8 aa, Artificial Sequence
  Description of Artificial Sequence: Synthetic peptide
GYTLTRSA

SEQ ID NO: 354 - protein, 10 aa, Artificial Sequence
  Description of Artificial Sequence: Synthetic peptide
GDSVSSNSAA

SEQ ID NO: 355 - protein, 10 aa, Artificial Sequence
  Description of Artificial Sequence: Synthetic peptide
GGSISSRSHY

SEQ ID NO: 356 - protein, 10 aa, Artificial Sequence
  Description of Artificial Sequence: Synthetic peptide
GGSIRSSSYY

SEQ ID NO: 357 - protein, 8 aa, Artificial Sequence
  Description of Artificial Sequence: Synthetic peptide
GFTFSSYW

SEQ ID NO: 358 - protein, 8 aa, Artificial Sequence
  Description of Artificial Sequence: Synthetic peptide
GFTFSSYW

SEQ ID NO: 359 - protein, 8 aa, Artificial Sequence
  Description of Artificial Sequence: Synthetic peptide
GYTFSTYA

SEQ ID NO: 360 - protein, 8 aa, Artificial Sequence
  Description of Artificial Sequence: Synthetic peptide
GFTFDDYA

SEQ ID NO: 361 - protein, 8 aa, Artificial Sequence
  Description of Artificial Sequence: Synthetic peptide
GFTFDDYA

SEQ ID NO: 362 - protein, 8 aa, Artificial Sequence
  Description of Artificial Sequence: Synthetic peptide
GFTFDDYA

SEQ ID NO: 363 - protein, 8 aa, Artificial Sequence
  Description of Artificial Sequence: Synthetic peptide
GFTFDDYA

SEQ ID NO: 364 - protein, 8 aa, Artificial Sequence
  Description of Artificial Sequence: Synthetic peptide
GFTFRSYA

SEQ ID NO: 365 - protein, 8 aa, Artificial Sequence
  Description of Artificial Sequence: Synthetic peptide
GFTFSYYG

SEQ ID NO: 366 - protein, 8 aa, Artificial Sequence
  Description of Artificial Sequence: Synthetic peptide
GFTFDDYA

SEQ ID NO: 367 - protein, 8 aa, Artificial Sequence
  Description of Artificial Sequence: Synthetic peptide
GFTFSNYG

SEQ ID NO: 368 - protein, 7 aa, Artificial Sequence
  Description of Artificial Sequence: Synthetic peptide
IYWDDDK

SEQ ID NO: 369 - protein, 10 aa, Artificial Sequence
  Description of Artificial Sequence: Synthetic peptide
IRSKYNNYAT

SEQ ID NO: 370 - protein, 9 aa, Artificial Sequence
  Description of Artificial Sequence: Synthetic peptide
TYYRSKWLY

SEQ ID NO: 371 - protein, 7 aa, Artificial Sequence
  Description of Artificial Sequence: Synthetic peptide
IYYSGNT

SEQ ID NO: 372 - protein, 9 aa, Artificial Sequence
  Description of Artificial Sequence: Synthetic peptide
TYYRSKWYN

SEQ ID NO: 373 - protein, 8 aa, Artificial Sequence
  Description of Artificial Sequence: Synthetic peptide
ISYDGSNK

SEQ ID NO: 374 - protein, 8 aa, Artificial Sequence
  Description of Artificial Sequence: Synthetic peptide
INTNTGNP

SEQ ID NO: 375 - protein, 7 aa, Artificial Sequence
  Description of Artificial Sequence: Synthetic peptide
IYYSGNT

SEQ ID NO: 376 - protein, 7 aa, Artificial Sequence
  Description of Artificial Sequence: Synthetic peptide
IYYSGNT

SEQ ID NO: 377 - protein, 7 aa, Artificial Sequence
  Description of Artificial Sequence: Synthetic peptide
IYYSGNT

SEQ ID NO: 378 - protein, 7 aa, Artificial Sequence
  Description of Artificial Sequence: Synthetic peptide
IYSSGNT

SEQ ID NO: 379 - protein, 7 aa, Artificial Sequence
  Description of Artificial Sequence: Synthetic peptide
IYHSGNT

SEQ ID NO: 380 - protein, 8 aa, Artificial Sequence
  Description of Artificial Sequence: Synthetic peptide
ISYDGSNK

SEQ ID NO: 381 - protein, 8 aa, Artificial Sequence
  Description of Artificial Sequence: Synthetic peptide
ISYDGSNK

SEQ ID NO: 382 - protein, 8 aa, Artificial Sequence
  Description of Artificial Sequence: Synthetic peptide
IDYSGNDT

SEQ ID NO: 383 - protein, 7 aa, Artificial Sequence
  Description of Artificial Sequence: Synthetic peptide
INYSGST

SEQ ID NO: 384 - protein, 7 aa, Artificial Sequence
  Description of Artificial Sequence: Synthetic peptide
IYSSGNT

SEQ ID NO: 385 - protein, 8 aa, Artificial Sequence
  Description of Artificial Sequence: Synthetic peptide
IKQHGSEK

SEQ ID NO: 386 - protein, 8 aa, Artificial Sequence
  Description of Artificial Sequence: Synthetic peptide
INISGGST

SEQ ID NO: 387 - protein, 8 aa, Artificial Sequence
  Description of Artificial Sequence: Synthetic peptide
ISYDGSNK

SEQ ID NO: 388 - protein, 8 aa, Artificial Sequence
  Description of Artificial Sequence: Synthetic peptide
ISGSGGST

SEQ ID NO: 389 - protein, 8 aa, Artificial Sequence
  Description of Artificial Sequence: Synthetic peptide
ISYDGSNK

SEQ ID NO: 390 - protein, 8 aa, Artificial Sequence
  Description of Artificial Sequence: Synthetic peptide
INTNTGNP

SEQ ID NO: 391 - protein, 8 aa, Artificial Sequence
  Description of Artificial Sequence: Synthetic peptide
ISYDGSNK

SEQ ID NO: 392 - protein, 8 aa, Artificial Sequence
  Description of Artificial Sequence: Synthetic peptide
ISYDGSNK

SEQ ID NO: 393 - protein, 8 aa, Artificial Sequence
  Description of Artificial Sequence: Synthetic peptide
IKQHGSEK

SEQ ID NO: 394 - protein, 8 aa, Artificial Sequence
  Description of Artificial Sequence: Synthetic peptide
INTNTGNP

SEQ ID NO: 395 - protein, 9 aa, Artificial Sequence
  Description of Artificial Sequence: Synthetic peptide
TYYRSKWYN

SEQ ID NO: 396 - protein, 7 aa, Artificial Sequence
  Description of Artificial Sequence: Synthetic peptide
IYYTGST

SEQ ID NO: 397 - protein, 7 aa, Artificial Sequence
  Description of Artificial Sequence: Synthetic peptide
IYSSGNT

SEQ ID NO: 398 - protein, 8 aa, Artificial Sequence
  Description of Artificial Sequence: Synthetic peptide
IKQHGSEK

SEQ ID NO: 399 - protein, 8 aa, Artificial Sequence
  Description of Artificial Sequence: Synthetic peptide
IKRDGGEK

SEQ ID NO: 400 - protein, 8 aa, Artificial Sequence
  Description of Artificial Sequence: Synthetic peptide
INTNTGNP

SEQ ID NO: 401 - protein, 8 aa, Artificial Sequence
  Description of Artificial Sequence: Synthetic peptide
LSWNGGNI

SEQ ID NO: 402 - protein, 8 aa, Artificial Sequence
  Description of Artificial Sequence: Synthetic peptide
LSWNGGNI

SEQ ID NO: 403 - protein, 8 aa, Artificial Sequence
  Description of Artificial Sequence: Synthetic peptide
IGWSGGSI

SEQ ID NO: 404 - protein, 8 aa, Artificial Sequence
  Description of Artificial Sequence: Synthetic peptide
IGWSGGSI

SEQ ID NO: 405 - protein, 8 aa, Artificial Sequence
  Description of Artificial Sequence: Synthetic peptide
INGYGDGR

SEQ ID NO: 406 - protein, 8 aa, Artificial Sequence
  Description of Artificial Sequence: Synthetic peptide
IWFDGNNK

SEQ ID NO: 407 - protein, 8 aa, Artificial Sequence
  Description of Artificial Sequence: Synthetic peptide
ISWNGGDM

SEQ ID NO: 408 - protein, 8 aa, Artificial Sequence
  Description of Artificial Sequence: Synthetic peptide
IWYVGSHK

SEQ ID NO: 409 - protein, 12 aa, Artificial Sequence
  Description of Artificial Sequence: Synthetic peptide
ARLYGFTYGFAY

SEQ ID NO: 410 - protein, 16 aa, Artificial Sequence
  Description of Artificial Sequence: Synthetic peptide
ARHGNFGNSYVSWFAY

SEQ ID NO: 411 - protein, 10 aa, Artificial Sequence
  Description of Artificial Sequence: Synthetic peptide
ARGYSSSFDY

SEQ ID NO: 412 - protein, 17 aa, Artificial Sequence
  Description of Artificial Sequence: Synthetic peptide
ARLADVVVVPAARYFDS

SEQ ID NO: 413 - protein, 12 aa, Artificial Sequence
  Description of Artificial Sequence: Synthetic peptide
ARETMFRGLMDY

SEQ ID NO: 414 - protein, 22 aa, Artificial Sequence
  Description of Artificial Sequence: Synthetic peptide
AKDFRSLDWLPPDSTSYDGMDV

SEQ ID NO: 415 - protein, 9 aa, Artificial Sequence
  Description of Artificial Sequence: Synthetic peptide
ARDREVRDY

SEQ ID NO: 416 - protein, 17 aa, Artificial Sequence
  Description of Artificial Sequence: Synthetic peptide
ARLADVVVVPAARYFDY

SEQ ID NO: 417 - protein, 17 aa, Artificial Sequence
  Description of Artificial Sequence: Synthetic peptide
ARLADVVVVPAARYFDN

SEQ ID NO: 418 - protein, 17 aa, Artificial Sequence
  Description of Artificial Sequence: Synthetic peptide
ARLGSLVVVPAAMSFDY

SEQ ID NO: 419 - protein, 17 aa, Artificial Sequence
  Description of Artificial Sequence: Synthetic peptide
ARLGSLVVVPAAMSFDY

SEQ ID NO: 420 - protein, 12 aa, Artificial Sequence
  Description of Artificial Sequence: Synthetic peptide
ARIIAVARYFDS

SEQ ID NO: 421 - protein, 22 aa, Artificial Sequence
  Description of Artificial Sequence: Synthetic peptide
AKDFRDFDWLPPDSTSYHGMDV

SEQ ID NO: 422 - protein, 22 aa, Artificial Sequence
  Description of Artificial Sequence: Synthetic peptide
AKDFRSFDWLPPDSASYHGMDV

SEQ ID NO: 423 - protein, 13 aa, Artificial Sequence
  Description of Artificial Sequence: Synthetic peptide
AKESQLLHGLFEH

SEQ ID NO: 424 - protein, 12 aa, Artificial Sequence
  Description of Artificial Sequence: Synthetic peptide
ARLDGYESPFDY

SEQ ID NO: 425 - protein, 17 aa, Artificial Sequence
  Description of Artificial Sequence: Synthetic peptide
ARLGSLVVVPAAMSFDY

SEQ ID NO: 426 - protein, 11 aa, Artificial Sequence
  Description of Artificial Sequence: Synthetic peptide
ARDRDLGYFDY

SEQ ID NO: 427 - protein, 12 aa, Artificial Sequence
  Description of Artificial Sequence: Synthetic peptide
TKGGYSSGPFDY

SEQ ID NO: 428 - protein, 22 aa, Artificial Sequence
  Description of Artificial Sequence: Synthetic peptide
AKDFRSFDWLPPDSASYHGMDV

SEQ ID NO: 429 - protein, 15 aa, Artificial Sequence
  Description of Artificial Sequence: Synthetic peptide
ARTYNSGYYDGDFDY

SEQ ID NO: 430 - protein, 22 aa, Artificial Sequence
  Description of Artificial Sequence: Synthetic peptide
AKDFRYFDWLPPDSSSYYGMDV

SEQ ID NO: 431 - protein, 10 aa, Artificial Sequence
  Description of Artificial Sequence: Synthetic peptide
ATDRDRGTDY

SEQ ID NO: 432 - protein, 22 aa, Artificial Sequence
  Description of Artificial Sequence: Synthetic peptide
AKDFRSFDWLPPDSASYHGMDV

SEQ ID NO: 433 - protein, 22 aa, Artificial Sequence
  Description of Artificial Sequence: Synthetic peptide
AKDFRSFDWLPPDSTSYYGMDV

SEQ ID NO: 434 - protein, 11 aa, Artificial Sequence
  Description of Artificial Sequence: Synthetic peptide
ARDRDLGYFDY

SEQ ID NO: 435 - protein, 12 aa, Artificial Sequence
  Description of Artificial Sequence: Synthetic peptide
ASDILPGYHEDY

SEQ ID NO: 436 - protein, 12 aa, Artificial Sequence
  Description of Artificial Sequence: Synthetic peptide
AREVAVAASFDY

SEQ ID NO: 437 - protein, 17 aa, Artificial Sequence
  Description of Artificial Sequence: Synthetic peptide
ARLADIVVVPAARYFDY

SEQ ID NO: 438 - protein, 17 aa, Artificial Sequence
  Description of Artificial Sequence: Synthetic peptide
ARLAATIVVPAARYFDC

SEQ ID NO: 439 - protein, 11 aa, Artificial Sequence
  Description of Artificial Sequence: Synthetic peptide
ARDRDLGYFDY

SEQ ID NO: 440 - protein, 10 aa, Artificial Sequence
  Description of Artificial Sequence: Synthetic peptide
ARPFYDHFDY

SEQ ID NO: 441 - protein, 10 aa, Artificial Sequence
  Description of Artificial Sequence: Synthetic peptide
ARDRDRGTDY

SEQ ID NO: 442 - protein, 12 aa, Artificial Sequence
  Description of Artificial Sequence: Synthetic peptide
TKDTPYGDYFDY

SEQ ID NO: 443 - protein, 12 aa, Artificial Sequence
  Description of Artificial Sequence: Synthetic peptide
AKDSPYGDYFDY

SEQ ID NO: 444 - protein, 12 aa, Artificial Sequence
  Description of Artificial Sequence: Synthetic peptide
AKDSPYGDFFDY

SEQ ID NO: 445 - protein, 12 aa, Artificial Sequence
  Description of Artificial Sequence: Synthetic peptide
AKDSPYGDFFDY

SEQ ID NO: 446 - protein, 13 aa, Artificial Sequence
  Description of Artificial Sequence: Synthetic peptide
AKDQGFGELFFDY

SEQ ID NO: 447 - protein, 10 aa, Artificial Sequence
  Description of Artificial Sequence: Synthetic peptide
ARDRELLFDY

SEQ ID NO: 448 - protein, 22 aa, Artificial Sequence
  Description of Artificial Sequence: Synthetic peptide
VKDMPYFDFLTGSDYYYYGMDV

SEQ ID NO: 449 - protein, 10 aa, Artificial Sequence
  Description of Artificial Sequence: Synthetic peptide
ARDGSLCFDY

SEQ ID NO: 450 - protein, 10 aa, Artificial Sequence
  Description of Artificial Sequence: Synthetic peptide
QSVDYNGISY

SEQ ID NO: 451 - protein, 9 aa, Artificial Sequence
  Description of Artificial Sequence: Synthetic peptide
TGAVTTSNY

SEQ ID NO: 452 - protein, 9 aa, Artificial Sequence
  Description of Artificial Sequence: Synthetic peptide
SSNIGTYKF

SEQ ID NO: 453 - protein, 6 aa, Artificial Sequence
  Description of Artificial Sequence: Synthetic peptide
KLGNKY

SEQ ID NO: 454 - protein, 6 aa, Artificial Sequence
  Description of Artificial Sequence: Synthetic peptide
NIGSKS

SEQ ID NO: 455 - protein, 6 aa, Artificial Sequence
  Description of Artificial Sequence: Synthetic peptide
KLGDKY

SEQ ID NO: 456 - protein, 6 aa, Artificial Sequence
  Description of Artificial Sequence: Synthetic peptide
KLGDKY

SEQ ID NO: 457 - protein, 6 aa, Artificial Sequence
  Description of Artificial Sequence: Synthetic peptide
KLGDKY

SEQ ID NO: 458 - protein, 6 aa, Artificial Sequence
  Description of Artificial Sequence: Synthetic peptide
KLGDKY

SEQ ID NO: 459 - protein, 6 aa, Artificial Sequence
  Description of Artificial Sequence: Synthetic peptide
KLGDKY

SEQ ID NO: 460 - protein, 6 aa, Artificial Sequence
  Description of Artificial Sequence: Synthetic peptide
KLGDKY

SEQ ID NO: 461 - protein, 6 aa, Artificial Sequence
  Description of Artificial Sequence: Synthetic peptide
NIGIKS

SEQ ID NO: 462 - protein, 6 aa, Artificial Sequence
  Description of Artificial Sequence: Synthetic peptide
KLGDKY

SEQ ID NO: 463 - protein, 6 aa, Artificial Sequence
  Description of Artificial Sequence: Synthetic peptide
KLGDKY

SEQ ID NO: 464 - protein, 12 aa, Artificial Sequence
  Description of Artificial Sequence: Synthetic peptide
QSVLYSSNNKNY

SEQ ID NO: 465 - protein, 6 aa, Artificial Sequence
  Description of Artificial Sequence: Synthetic peptide
QGISSW

SEQ ID NO: 466 - protein, 6 aa, Artificial Sequence
  Description of Artificial Sequence: Synthetic peptide
KLGAKF

SEQ ID NO: 467 - protein, 6 aa, Artificial Sequence
  Description of Artificial Sequence: Synthetic peptide
KLGDKY

SEQ ID NO: 468 - protein, 6 aa, Artificial Sequence
  Description of Artificial Sequence: Synthetic peptide
KLGDKY

SEQ ID NO: 469 - protein, 9 aa, Artificial Sequence
  Description of Artificial Sequence: Synthetic peptide
SSDDGKNNI

SEQ ID NO: 470 - protein, 6 aa, Artificial Sequence
  Description of Artificial Sequence: Synthetic peptide
ELGNKY

SEQ ID NO: 471 - protein, 9 aa, Artificial Sequence
  Description of Artificial Sequence: Synthetic peptide
SSDVGDYNY

SEQ ID NO: 472 - protein, 6 aa, Artificial Sequence
  Description of Artificial Sequence: Synthetic peptide
KLGDKY

SEQ ID NO: 473 - protein, 6 aa, Artificial Sequence
  Description of Artificial Sequence: Synthetic peptide
KLGDKY

SEQ ID NO: 474 - protein, 6 aa, Artificial Sequence
  Description of Artificial Sequence: Synthetic peptide
KLGNKY

SEQ ID NO: 475 - protein, 9 aa, Artificial Sequence
  Description of Artificial Sequence: Synthetic peptide
NSDVGSYDL

SEQ ID NO: 476 - protein, 6 aa, Artificial Sequence
  Description of Artificial Sequence: Synthetic peptide
NIGSKS

SEQ ID NO: 477 - protein, 6 aa, Artificial Sequence
  Description of Artificial Sequence: Synthetic peptide
KLGDKY

SEQ ID NO: 478 - protein, 6 aa, Artificial Sequence
  Description of Artificial Sequence: Synthetic peptide
RLGDKY

SEQ ID NO: 479 - protein, 6 aa, Artificial Sequence
  Description of Artificial Sequence: Synthetic peptide
KLGSKF

SEQ ID NO: 480 - protein, 6 aa, Artificial Sequence
  Description of Artificial Sequence: Synthetic peptide
NIGKIS

SEQ ID NO: 481 - protein, 9 aa, Artificial Sequence
  Description of Artificial Sequence: Synthetic peptide
SSDVGDDNY

SEQ ID NO: 482 - protein, 6 aa, Artificial Sequence
  Description of Artificial Sequence: Synthetic peptide
QGISSW

SEQ ID NO: 483 - protein, 6 aa, Artificial Sequence
  Description of Artificial Sequence: Synthetic peptide
QGISSW

SEQ ID NO: 484 - protein, 12 aa, Artificial Sequence
  Description of Artificial Sequence: Synthetic peptide
QTVLYSSNNKNY

SEQ ID NO: 485 - protein, 12 aa, Artificial Sequence
  Description of Artificial Sequence: Synthetic peptide
QTVFYSSNNKNY

SEQ ID NO: 486 - protein, 6 aa, Artificial Sequence
  Description of Artificial Sequence: Synthetic peptide
QSISSW

SEQ ID NO: 487 - protein, 6 aa, Artificial Sequence
  Description of Artificial Sequence: Synthetic peptide
ELGDMY

SEQ ID NO: 488 - protein, 6 aa, Artificial Sequence
  Description of Artificial Sequence: Synthetic peptide
NLGNEH

SEQ ID NO: 489 - protein, 6 aa, Artificial Sequence
  Description of Artificial Sequence: Synthetic peptide
TLGYNY

SEQ ID NO: 490 - protein, 6 aa, Artificial Sequence
  Description of Artificial Sequence: Synthetic peptide
KLGDKY

SEQ ID NO: 491 - protein, 6 aa, Artificial Sequence
  Description of Artificial Sequence: Synthetic peptide
KLGNKY

SEQ ID NO: 492 - protein, 3 aa, Artificial Sequence
  Description of Artificial Sequence: Synthetic peptide
AAS

SEQ ID NO: 493 - protein, 3 aa, Artificial Sequence
  Description of Artificial Sequence: Synthetic peptide
GTN

SEQ ID NO: 494 - protein, 3 aa, Artificial Sequence
  Description of Artificial Sequence: Synthetic peptide
EVS

SEQ ID NO: 495 - protein, 3 aa, Artificial Sequence
  Description of Artificial Sequence: Synthetic peptide
QDS

SEQ ID NO: 496 - protein, 3 aa, Artificial Sequence
  Description of Artificial Sequence: Synthetic peptide
DDS

SEQ ID NO: 497 - protein, 3 aa, Artificial Sequence
  Description of Artificial Sequence: Synthetic peptide
KDS

SEQ ID NO: 498 - protein, 3 aa, Artificial Sequence
  Description of Artificial Sequence: Synthetic peptide
QDS

SEQ ID NO: 499 - protein, 3 aa, Artificial Sequence
  Description of Artificial Sequence: Synthetic peptide
QDY

SEQ ID NO: 500 - protein, 3 aa, Artificial Sequence
  Description of Artificial Sequence: Synthetic peptide
QDY

SEQ ID NO: 501 - protein, 3 aa, Artificial Sequence
  Description of Artificial Sequence: Synthetic peptide
QDS

SEQ ID NO: 502 - protein, 3 aa, Artificial Sequence
  Description of Artificial Sequence: Synthetic peptide
QDS

SEQ ID NO: 503 - protein, 3 aa, Artificial Sequence
  Description of Artificial Sequence: Synthetic peptide
DDS

SEQ ID NO: 504 - protein, 3 aa, Artificial Sequence
  Description of Artificial Sequence: Synthetic peptide
QDR

SEQ ID NO: 505 - protein, 3 aa, Artificial Sequence
  Description of Artificial Sequence: Synthetic peptide
QDG

SEQ ID NO: 506 - protein, 3 aa, Artificial Sequence
  Description of Artificial Sequence: Synthetic peptide
WAS

SEQ ID NO: 507 - protein, 3 aa, Artificial Sequence
  Description of Artificial Sequence: Synthetic peptide
AAS

SEQ ID NO: 508 - protein, 3 aa, Artificial Sequence
  Description of Artificial Sequence: Synthetic peptide
QDN

SEQ ID NO: 509 - protein, 3 aa, Artificial Sequence
  Description of Artificial Sequence: Synthetic peptide
QDS

SEQ ID NO: 510 - protein, 3 aa, Artificial Sequence
  Description of Artificial Sequence: Synthetic peptide
QDN

SEQ ID NO: 511 - protein, 3 aa, Artificial Sequence
  Description of Artificial Sequence: Synthetic peptide
KDS

SEQ ID NO: 512 - protein, 3 aa, Artificial Sequence
  Description of Artificial Sequence: Synthetic peptide
QDR

SEQ ID NO: 513 - protein, 3 aa, Artificial Sequence
  Description of Artificial Sequence: Synthetic peptide
DVS

SEQ ID NO: 514 - protein, 3 aa, Artificial Sequence
  Description of Artificial Sequence: Synthetic peptide
QDN

SEQ ID NO: 515 - protein, 3 aa, Artificial Sequence
  Description of Artificial Sequence: Synthetic peptide
QDR

SEQ ID NO: 516 - protein, 3 aa, Artificial Sequence
  Description of Artificial Sequence: Synthetic peptide
QDT

SEQ ID NO: 517 - protein, 3 aa, Artificial Sequence
  Description of Artificial Sequence: Synthetic peptide
DGS

SEQ ID NO: 518 - protein, 3 aa, Artificial Sequence
  Description of Artificial Sequence: Synthetic peptide
DDS

SEQ ID NO: 519 - protein, 3 aa, Artificial Sequence
  Description of Artificial Sequence: Synthetic peptide
QDS

SEQ ID NO: 520 - protein, 3 aa, Artificial Sequence
  Description of Artificial Sequence: Synthetic peptide
QDS

SEQ ID NO: 521 - protein, 3 aa, Artificial Sequence
  Description of Artificial Sequence: Synthetic peptide
QDS

SEQ ID NO: 522 - protein, 3 aa, Artificial Sequence
  Description of Artificial Sequence: Synthetic peptide
DDR

SEQ ID NO: 523 - protein, 3 aa, Artificial Sequence
  Description of Artificial Sequence: Synthetic peptide
DVS

SEQ ID NO: 524 - protein, 3 aa, Artificial Sequence
  Description of Artificial Sequence: Synthetic peptide
RSS

SEQ ID NO: 525 - protein, 3 aa, Artificial Sequence
  Description of Artificial Sequence: Synthetic peptide
GAS

SEQ ID NO: 526 - protein, 3 aa, Artificial Sequence
  Description of Artificial Sequence: Synthetic peptide
WAS

SEQ ID NO: 527 - protein, 3 aa, Artificial Sequence
  Description of Artificial Sequence: Synthetic peptide
WAS

SEQ ID NO: 528 - protein, 3 aa, Artificial Sequence
  Description of Artificial Sequence: Synthetic peptide
KAS

SEQ ID NO: 529 - protein, 3 aa, Artificial Sequence
  Description of Artificial Sequence: Synthetic peptide
QDS

SEQ ID NO: 530 - protein, 3 aa, Artificial Sequence
  Description of Artificial Sequence: Synthetic peptide
QNN

SEQ ID NO: 531 - protein, 3 aa, Artificial Sequence
  Description of Artificial Sequence: Synthetic peptide
QDT

SEQ ID NO: 532 - protein, 3 aa, Artificial Sequence
  Description of Artificial Sequence: Synthetic peptide
QDG

SEQ ID NO: 533 - protein, 3 aa, Artificial Sequence
  Description of Artificial Sequence: Synthetic peptide
QDS

SEQ ID NO: 534 - protein, 9 aa, Artificial Sequence
  Description of Artificial Sequence: Synthetic peptide
QQIIEDPWT

SEQ ID NO: 535 - protein, 9 aa, Artificial Sequence
  Description of Artificial Sequence: Synthetic peptide
ALWYSNLWV

SEQ ID NO: 536 - protein, 10 aa, Artificial Sequence
  Description of Artificial Sequence: Synthetic peptide
VSYAGSGTLL

SEQ ID NO: 537 - protein, 9 aa, Artificial Sequence
  Description of Artificial Sequence: Synthetic peptide
QAWDSSTYV

SEQ ID NO: 538 - protein, 10 aa, Artificial Sequence
  Description of Artificial Sequence: Synthetic peptide
QVWDSSSDVV

SEQ ID NO: 539 - protein, 9 aa, Artificial Sequence
  Description of Artificial Sequence: Synthetic peptide
QAWDSSTVV

SEQ ID NO: 540 - protein, 9 aa, Artificial Sequence
  Description of Artificial Sequence: Synthetic peptide
QAWDSSTVV

SEQ ID NO: 541 - protein, 9 aa, Artificial Sequence
  Description of Artificial Sequence: Synthetic peptide
QAWDSSTYV

SEQ ID NO: 542 - protein, 9 aa, Artificial Sequence
  Description of Artificial Sequence: Synthetic peptide
QAWDISTYV

SEQ ID NO: 543 - protein, 9 aa, Artificial Sequence
  Description of Artificial Sequence: Synthetic peptide
QAWDSSTWV

SEQ ID NO: 544 - protein, 9 aa, Artificial Sequence
  Description of Artificial Sequence: Synthetic peptide
QAWDSSTWV

SEQ ID NO: 545 - protein, 11 aa, Artificial Sequence
  Description of Artificial Sequence: Synthetic peptide
QVWDSSSDHVV

SEQ ID NO: 546 - protein, 9 aa, Artificial Sequence
  Description of Artificial Sequence: Synthetic peptide
QAWDSSTVV

SEQ ID NO: 547 - protein, 9 aa, Artificial Sequence
  Description of Artificial Sequence: Synthetic peptide
QAWDRNTVV

SEQ ID NO: 548 - protein, 9 aa, Artificial Sequence
  Description of Artificial Sequence: Synthetic peptide
QQYYGTPWT

SEQ ID NO: 549 - protein, 9 aa, Artificial Sequence
  Description of Artificial Sequence: Synthetic peptide
QQANSFPFT

SEQ ID NO: 550 - protein, 9 aa, Artificial Sequence
  Description of Artificial Sequence: Synthetic peptide
QAWDSSTVV

SEQ ID NO: 551 - protein, 10 aa, Artificial Sequence
  Description of Artificial Sequence: Synthetic peptide
QAWDSSTGVV

SEQ ID NO: 552 - protein, 9 aa, Artificial Sequence
  Description of Artificial Sequence: Synthetic peptide
QAWGRNTVV

SEQ ID NO: 553 - protein, 11 aa, Artificial Sequence
  Description of Artificial Sequence: Synthetic peptide
CSYAGASNHVV

SEQ ID NO: 554 - protein, 9 aa, Artificial Sequence
  Description of Artificial Sequence: Synthetic peptide
QAWDSSTVV

SEQ ID NO: 555 - protein, 11 aa, Artificial Sequence
  Description of Artificial Sequence: Synthetic peptide
SSYSSSSALEV

SEQ ID NO: 556 - protein, 9 aa, Artificial Sequence
  Description of Artificial Sequence: Synthetic peptide
QAWDSNTVV

SEQ ID NO: 557 - protein, 9 aa, Artificial Sequence
  Description of Artificial Sequence: Synthetic peptide
QAWDSSTVV

SEQ ID NO: 558 - protein, 9 aa, Artificial Sequence
  Description of Artificial Sequence: Synthetic peptide
QAWDSSTVV

SEQ ID NO: 559 - protein, 11 aa, Artificial Sequence
  Description of Artificial Sequence: Synthetic peptide
CSYEVTTTYVV

SEQ ID NO: 560 - protein, 11 aa, Artificial Sequence
  Description of Artificial Sequence: Synthetic peptide
QVWDSNSDHVV

SEQ ID NO: 561 - protein, 9 aa, Artificial Sequence
  Description of Artificial Sequence: Synthetic peptide
QAWDSSTYV

SEQ ID NO: 562 - protein, 9 aa, Artificial Sequence
  Description of Artificial Sequence: Synthetic peptide
QAWDSSSYV

SEQ ID NO: 563 - protein, 9 aa, Artificial Sequence
  Description of Artificial Sequence: Synthetic peptide
QAWDSSTVV

SEQ ID NO: 564 - protein, 11 aa, Artificial Sequence
  Description of Artificial Sequence: Synthetic peptide
QVWNSSSVHPV

SEQ ID NO: 565 - protein, 11 aa, Artificial Sequence
  Description of Artificial Sequence: Synthetic peptide
SSYSSSTTLEV

SEQ ID NO: 566 - protein, 9 aa, Artificial Sequence
  Description of Artificial Sequence: Synthetic peptide
QQDNSFPYT

SEQ ID NO: 567 - protein, 9 aa, Artificial Sequence
  Description of Artificial Sequence: Synthetic peptide
QQDNSFPYT

SEQ ID NO: 568 - protein, 9 aa, Artificial Sequence
  Description of Artificial Sequence: Synthetic peptide
QHYYSTPYT

SEQ ID NO: 569 - protein, 9 aa, Artificial Sequence
  Description of Artificial Sequence: Synthetic peptide
QHYYSTPYT

SEQ ID NO: 570 - protein, 9 aa, Artificial Sequence
  Description of Artificial Sequence: Synthetic peptide
QQYNSYPWT

SEQ ID NO: 571 - protein, 9 aa, Artificial Sequence
  Description of Artificial Sequence: Synthetic peptide
QTWDTRIAV

SEQ ID NO: 572 - protein, 9 aa, Artificial Sequence
  Description of Artificial Sequence: Synthetic peptide
QAWDSTTAV

SEQ ID NO: 573 - protein, 9 aa, Artificial Sequence
  Description of Artificial Sequence: Synthetic peptide
QAWDITTVL

SEQ ID NO: 574 - protein, 9 aa, Artificial Sequence
  Description of Artificial Sequence: Synthetic peptide
QAWDRNTVV

SEQ ID NO: 575 - protein, 334 aa, Homo sapiens
FPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 576 - skipped

SEQ ID NO: 577 - protein, 41 aa, Unknown
  Description of Unknown: TMEFF2 sequence
HHIPCPEHYNGFCMHGKCEHSINMQEPSCRCDAGYTGQHCE

SEQ ID NO: 578 - protein, 304 aa, Artificial Sequence
  Description of Artificial Sequence: Synthetic polypeptide
FPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVGGGSHHHHHHLNDIFEAQKIEWHE

SEQ ID NO: 579 - protein, 797 aa, Artificial Sequence
  Description of Artificial Sequence: Synthetic polypeptide
SGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVGSGSGSENLYFQGVRSSSDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGSHHHHHHLNDIFEAQKIEWHE

SEQ ID NO: 580 - protein, 101 aa, Artificial Sequence
  Description of Artificial Sequence: Synthetic polypeptide
NTTTTTKSEDGHYARTDYAENANKLEESAREHHIPCPEHYNGFCMHGKCEHSINMQEPSCRCDAGYTGQHCEKKDYSVLYVVPGPVRFQYVGGGSHHHHHH

SEQ ID NO: 581 - protein, 333 aa, Artificial Sequence
  Description of Artificial Sequence: Synthetic polypeptide
NTTTTTKSEDGHYARTDYAENANKLEESAREHHIPCPEHYNGFCMHGKCEHSINMQEPSCRCDAGYTGQHCEKKDYSVLYVVPGPVRFQYVGGGSPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGKGGGSHHHHHH

SEQ ID NO: 582 - protein, 5 aa, Artificial Sequence
  Description of Artificial Sequence: Synthetic peptide
SYSMS

SEQ ID NO: 583 - protein, 5 aa, Artificial Sequence
  Description of Artificial Sequence: Synthetic peptide
SYYIS

SEQ ID NO: 584 - protein, 17 aa, Artificial Sequence
  Description of Artificial Sequence: Synthetic peptide
VISGSGGFTDYADSVKG

SEQ ID NO: 585 - protein, 17 aa, Artificial Sequence
  Description of Artificial Sequence: Synthetic peptide
GIIPISGRANYAQKFQG

SEQ ID NO: 586 - protein, 17 aa, Artificial Sequence
  Description of Artificial Sequence: Synthetic peptide
VISGGGSFTSYADSVKG

SEQ ID NO: 587 - protein, 9 aa, Artificial Sequence
  Description of Artificial Sequence: Synthetic peptide
MPLNSPHDY

SEQ ID NO: 588 - protein, 7 aa, Artificial Sequence
  Description of Artificial Sequence: Synthetic peptide
AASSLQS

SEQ ID NO: 589 - protein, 124 aa, Artificial Sequence
  Description of Artificial Sequence: Synthetic polypeptide
QVQLVQSGAEVKKPGSSVKVSCKASGGTFSSYYISWVRQAPGQGLEWMGGIIPISGRANYAQKFQGRVTITADESTSTAYMELSSLRSEDTAVYYCARDGYSSGRSTTYAFDYWGQGTLVTVSS

SEQ ID NO: 590 - DNA, 645 bp, Artificial Sequence
  Description of Artificial Sequence: Synthetic polynucleotide
gaaattgtgctgacccagagcccgggcaccctgagcctgagcccgggcgaacgcgcgaccctgagctgccgcgcgagccagagcgttgccacctattatcttgcgtggtatcagcagaaaccgggccaggcgccgcgcctgctgatttacggtgcatcctcccgtgcgaccggcattccggatcgctttagcggcagcggttccggcaccgattttaccctgaccattagccgcctggaaccggaagattttgcggtgtattattgccagcagtacggctataacccaattacctttggccagggcaccaaagtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 591 - protein, 96 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSP

SEQ ID NO: 592 - protein, 15 aa, Unknown
  Description of Unknown: TMEFF2 sequence
HGKCEHSINMQEPSC

SEQ ID NO: 593-595 - skipped (3 entries)

SEQ ID NO: 596 - protein, 6 aa, Artificial Sequence
  Description of Artificial Sequence: Synthetic 6xHis tag
HHHHHH

SEQ ID NO: 597-599 - skipped (3 entries)

SEQ ID NO: 600 - protein, 17 aa, Unknown
  Description of Unknown: TMEFF2 sequence
DAGYTGQHCEKKDYSVL

SEQ ID NO: 601 - protein, 330 aa, Homo sapiens [sequence omitted]

SEQ ID NO: 602 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 603 - protein, 9 aa, Artificial Sequence
  Description of Artificial Sequence: Synthetic peptide
LQDYNYPLT

SEQ ID NO: 604 - protein, 118 aa, Artificial Sequence
  Description of Artificial Sequence: Synthetic polypeptide
EVQLLESGGGLVQPGGSLRLSCAASGFTFSSYSMSWVRQAPGKGLEWVSVISGSGGFTDYADSVKGRFTISRDNSKNTLYLQMNSLRAEDTAVYYCARMPLNSPHDYWGQGTLVTVSS

SEQ ID NO: 605-606 - skipped (2 entries)

SEQ ID NO: 607 - protein, 107 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTDFTLTISSLQPEDFATYYCLQDYNYPLTFGGGTKVEIK

SEQ ID NO: 608-611 - skipped (4 entries)

SEQ ID NO: 612 - protein, 118 aa, Artificial Sequence
  Description of Artificial Sequence: Synthetic polypeptide
EVQLLESGGGLVQPGGSLRLSCAASGFTFSSYSMSWVRQAPGKGLEWVSVISGSGGFTDYADSVKGRFTISRDNSKNTLYLHMNSLRAEDTAVYYCARMPLNSPHDYWGQGTLVTVSS

SEQ ID NO: 613 - protein, 107 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPLTFGGGTKVEIK

SEQ ID NO: 614 - protein, 445 aa, Artificial Sequence
  Description of Artificial Sequence: Synthetic polypeptide
EVQLLESGGGLVQPGGSLRLSCAASGFTFSSYSMSWVRQAPGKGLEWVSVISGSGGFTDYADSVKGRFTISRDNSKNTLYLQMNSLRAEDTAVYYCARMPLNSPHDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 615 - protein, 214 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTDFTLTISSLQPEDFATYYCLQDYNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 616 - protein, 445 aa, Artificial Sequence
  Description of Artificial Sequence: Synthetic polypeptide
EVQLLESGGGLVQPGGSLRLSCAASGFTFSSYSMSWVRQAPGKGLEWVSVISGSGGFTDYADSVKGRFTISRDNSKNTLYLHMNSLRAEDTAVYYCARMPLNSPHDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 617 - protein, 214 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 618 - DNA, 354 bp, Artificial Sequence
  Description of Artificial Sequence: Synthetic polynucleotide
gaggtgcagctgctggaaagcggcggaggcctggtgcagcccggaggaagcctgagactcagctgtgccgccagcggcttcaccttcagcagctacagcatgagctgggtcaggcaggcccctggcaaaggactggagtgggtgagcgtgattagcggcagcggcggcttcaccgattacgccgacagcgtgaagggcaggttcaccatcagcagggacaatagcaagaacaccctgtacctgcagatgaacagcctgagggccgaggacaccgccgtgtactactgcgccaggatgcccctgaacagccctcacgactactggggccagggaaccctggtgaccgtgtccagc

SEQ ID NO: 619 - DNA, 321 bp, Artificial Sequence
  Description of Artificial Sequence: Synthetic polynucleotide
gacatccagatgacccagagccctagcagcctgagcgctagcgtgggcgacagggtgaccatcacctgcagggccagccagggcatcagaaacgacctgggctggtaccagcagaagcccggcaaggcccccaagctgctgatctacgccgccagcagcctgcagagcggagtgcctagcaggttcagcggaagcggcagcggcaccgacttcaccctgaccatcagcagcctgcagcccgaggacttcgccacctactactgcctgcaggactacaactaccccctgacattcggcggcggcaccaaggtggagatcaag

SEQ ID NO: 620 - DNA, 1335 bp, Artificial Sequence
  Description of Artificial Sequence: Synthetic polynucleotide
gaggtgcagctgctggaaagcggcggaggcctggtgcagcccggaggaagcctgagactcagctgtgccgccagcggcttcaccttcagcagctacagcatgagctgggtcaggcaggcccctggcaaaggactggagtgggtgagcgtgattagcggcagcggcggcttcaccgattacgccgacagcgtgaagggcaggttcaccatcagcagggacaatagcaagaacaccctgtacctgcagatgaacagcctgagggccgaggacaccgccgtgtactactgcgccaggatgcccctgaacagccctcacgactactggggccagggaaccctggtgaccgtgtccagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 621 - DNA, 645 bp, Artificial Sequence
  Description of Artificial Sequence: Synthetic polynucleotide
gacatccagatgacccagagccctagcagcctgagcgctagcgtgggcgacagggtgaccatcacctgcagggccagccagggcatcagaaacgacctgggctggtaccagcagaagcccggcaaggcccccaagctgctgatctacgccgccagcagcctgcagagcggagtgcctagcaggttcagcggaagcggcagcggcaccgacttcaccctgaccatcagcagcctgcagcccgaggacttcgccacctactactgcctgcaggactacaactaccccctgacattcggcggcggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 622 - DNA, 354 bp, Artificial Sequence
  Description of Artificial Sequence: Synthetic polynucleotide
gaggtgcagctgctggaaagcggcggaggcctggtgcagcccggaggaagcctgagactcagctgtgccgccagcggcttcaccttcagcagctacagcatgagctgggtcaggcaggcccctggcaaaggactggagtgggtgagcgtgattagcggcagcggcggcttcaccgattacgccgacagcgtgaagggcaggttcaccatcagcagggacaatagcaagaacaccctgtacctgcacatgaacagcctgagggccgaggacaccgccgtgtactactgcgccaggatgcccctgaacagccctcacgactactggggccagggaaccctggtgaccgtgtccagc

SEQ ID NO: 623 - DNA, 321 bp, Artificial Sequence
  Description of Artificial Sequence: Synthetic polynucleotide
gccatccagatgacccagagccctagcagcctgagcgctagcgtgggcgacagggtgaccatcacctgcagggccagccagggcatcagaaacgacctgggctggtaccagcagaagcccggcaaggcccccaagctgctgatctacgccgccagcagcctgcagagcggagtgcctagcaggttcagcggaagcggcagcggcaccgacttcaccctgaccatcagcagcctgcagcccgaggacttcgccacctactactgcctgcaggactacaactaccccctgacattcggcggcggcaccaaggtggagatcaag

SEQ ID NO: 624 - DNA, 1335 bp, Artificial Sequence
  Description of Artificial Sequence: Synthetic polynucleotide
gaggtgcagctgctggaaagcggcggaggcctggtgcagcccggaggaagcctgagactcagctgtgccgccagcggcttcaccttcagcagctacagcatgagctgggtcaggcaggcccctggcaaaggactggagtgggtgagcgtgattagcggcagcggcggcttcaccgattacgccgacagcgtgaagggcaggttcaccatcagcagggacaatagcaagaacaccctgtacctgcacatgaacagcctgagggccgaggacaccgccgtgtactactgcgccaggatgcccctgaacagccctcacgactactggggccagggaaccctggtgaccgtgtccagcgcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 625 - DNA, 645 bp, Artificial Sequence
  Description of Artificial Sequence: Synthetic polynucleotide
gccatccagatgacccagagccctagcagcctgagcgctagcgtgggcgacagggtgaccatcacctgcagggccagccagggcatcagaaacgacctgggctggtaccagcagaagcccggcaaggcccccaagctgctgatctacgccgccagcagcctgcagagcggagtgcctagcaggttcagcggaagcggcagcggcaccgacttcaccctgaccatcagcagcctgcagcccgaggacttcgccacctactactgcctgcaggactacaactaccccctgacattcggcggcggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 626 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 627 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK

SEQ ID NO: 628 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 629 - protein, 91 aa, Unknown
  Description of Unknown: TMEFF2 sequence
NTTTTTKSEDGHYARTDYAENANKLEESAREHHIPCPEHYNGFCMHGKCEHSINMQEPSCRCDAGYTGQHCEKKDYSVLYVVPGPVRFQYV

SEQ ID NO: 630 - protein, 11 aa, Artificial Sequence
  Description of Artificial Sequence: Synthetic peptide
RASQSVSSYLA

SEQ ID NO: 631 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASYRATGIPARFSGSGSGTDFTLTISSLEPEDFAVYYCQQRRNWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 632 - protein, 15 aa, Artificial Sequence
  Description of Artificial Sequence: Synthetic peptide
DSYDSSLYVGDYFDY

SEQ ID NO: 633 - protein, 447 aa, Artificial Sequence
  Description of Artificial Sequence: Synthetic polypeptide
QLQLQESGPGLVKPSETLSLTCTVSGVSISSSTYYWGWLRQPPGMGLEWTGSIYFTGNTYYNPSLKSRVTISVDTSRNQFSLKLSSVTAADTAVYYCGSLFGDYGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 634 - protein, 9 aa, Artificial Sequence
  Description of Artificial Sequence: Synthetic peptide
QAWDSSTVV

SEQ ID NO: 635 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 636 - protein, 104 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 637 - protein, 450 aa, Artificial Sequence
  Description of Artificial Sequence: Synthetic polypeptide
QVQLQQSGPGLVKPSQTLSLTCAISGDSVFNNNAAWTWIRQSPSRGLEWLGRTYYRSKWLYDYAVSVKSRITVNPDTSRNQFTLQLKSVTPEDTALYYCSRGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 638 - protein, 450 aa, Artificial Sequence
  Description of Artificial Sequence: Synthetic polypeptide
QVQLQQSGPGLVKPSQTLSLTCAISGDSVFNNNGAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 639 - protein, 450 aa, Artificial Sequence
  Description of Artificial Sequence: Synthetic polypeptide
QVRLQQSGPGLVKPSQTLSLTCAISGDSVFNNNAAWSWIRQSPSRGLEWLGRTYYRSKWLYDYAVTVKSRITVNPDTSRNQFTLQLTSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 640 - protein, 447 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK

SEQ ID NO: 641 - protein, 450 aa, Artificial Sequence
  Description of Artificial Sequence: Synthetic polypeptide
QVQLQQSGPGLVKPSQTLSLTCAISGDSVFNNNAAWSWIRQSPSRGLEWLGRTYYRSKWLYDYAVSVKSRITVNPDTSRNQFTLQLKSVTPEDTALYYCSRGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 642 - protein, 450 aa, Artificial Sequence
  Description of Artificial Sequence: Synthetic polypeptide
QVQLQQSGPGLVKPSQTLSLTCAISGDSVFNNNAAWSWIRQSPSRGLEWLGRTYYRSKWLYDYAVSVKSRITVNPDTSRNQFTLQLNSVTPEDTALYYCVRGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 643 - protein, 450 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 644 - protein, 450 aa, Artificial Sequence; identical to SEQ ID NO: 642
  Description of Artificial Sequence: Synthetic polypeptide

SEQ ID NO: 645 - protein, 216 aa, Artificial Sequence
  Description of Artificial Sequence: Synthetic polypeptide
QSALTQPASVSGSPGQSITISCTGTSSNIGTYKFVSWYQQHPDKAPKVLLYEVSKRPSGVSSRFSGSKSGNTASLTISGLQAEDQADYHCCSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 646 - protein, 216 aa, Artificial Sequence; identical to SEQ ID NO: 645
  Description of Artificial Sequence: Synthetic polypeptide

SEQ ID NO: 647 - protein, 216 aa, Artificial Sequence
  Description of Artificial Sequence: Synthetic polypeptide
QSALTQPASVSGSPGQSITISCTGTSRDIGTYKFVSWYQQHPDKAPKVLLYEVSKRPSGVSSRFSGSKSGNTASLTISGLQAEDQADYHCCSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 648 - protein, 216 aa, Artificial Sequence
  Description of Artificial Sequence: Synthetic polypeptide
QSALTQPASVSGSPGQSITISCTGTSRDIGTYKFVSWYQQHPDKAPKVLLYEVNKRPSGVSSRFSGSKSGNTASLTISGLQAEDQADYHCCSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 649 - protein, 216 aa, Artificial Sequence; identical to SEQ ID NO: 645
  Description of Artificial Sequence: Synthetic polypeptide

SEQ ID NO: 650 - protein, 216 aa, Artificial Sequence
  Description of Artificial Sequence: Synthetic polypeptide
QSALTQPASVSGSPGQSITISCTGTSSDIGTYKFVSWYQQHPDKAPKVLLYEVSKRPSGVSSRFSGSKSDNTASLTISGLQAEDQADYHCCSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 651 - protein, 120 aa, Artificial Sequence
  Description of Artificial Sequence: Synthetic polypeptide
QVQLQQSGPGLVKPSQTLSLTCAISGDSVFNNNAAWSWIRQSPSRGLEWLGRTYYRSKWLYDYAVSVKSRITVNPDTSRNQFTLQLNSVTPEDTALYYCVRGYSSSFDYWGQGTLVTVSS

SEQ ID NO: 652 - protein, 120 aa, Artificial Sequence; identical to SEQ ID NO: 20
  Description of Artificial Sequence: Synthetic polypeptide

SEQ ID NO: 653 - protein, 120 aa, Artificial Sequence
  Description of Artificial Sequence: Synthetic polypeptide
QVQLQQSGPGLVKPSQTLSLTCAISGDSVFNNNAAWSWIRQSPSRGLEWLGRTYYRSKWLYDYAVSVKSRITVNPDTSRNQFTLQLKSVTPEDTALYYCSRGYSSSFDYWGQGTLVTVSS

SEQ ID NO: 654 - protein, 120 aa, Artificial Sequence
  Description of Artificial Sequence: Synthetic polypeptide
QVQLQQSGPGLVKPSQTLSLTCAISGDSVFNNNGAWSWIRQSPSRGLEWLGRTYYRSKWLYDYAVSVKSRITVNPDTSRNQFTLQLNSVTPEDTALYYCARGYSSSFDYWGQGTLVTVSS

SEQ ID NO: 655 - protein, 120 aa, Artificial Sequence
  Description of Artificial Sequence: Synthetic polypeptide
QVRLQQSGPGLVKPSQTLSLTCAISGDSVFNNNAAWSWIRQSPSRGLEWLGRTYYRSKWLYDYAVTVKSRITVNPDTSRNQFTLQLTSVTPEDTALYYCARGYSSSFDYWGQGTLVTVSS

SEQ ID NO: 656 - protein, 120 aa, Artificial Sequence
  Description of Artificial Sequence: Synthetic polypeptide
QVQLQQSGPGLVKPSQTLSLTCAISGDSVFNNNAAWTWIRQSPSRGLEWLGRTYYRSKWLYDYAVSVKSRITVNPDTSRNQFTLQLKSVTPEDTALYYCSRGYSSSFDYWGQGTLVTVSS

SEQ ID NO: 657 - protein, 120 aa, Artificial Sequence
  Description of Artificial Sequence: Synthetic polypeptide
QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSS

SEQ ID NO: 658 - protein, 110 aa, Artificial Sequence
  Description of Artificial Sequence: Synthetic polypeptide
QSALTQPASVSGSPGQSITISCTGTSRDIGTYKFVSWYQQHPDKAPKVLLYEVNKRPSGVSSRFSGSKSGNTASLTISGLQAEDQADYHCCSYAGSGTLLFGGGTKLTVL

SEQ ID NO: 659 - protein, 110 aa, Artificial Sequence
  Description of Artificial Sequence: Synthetic polypeptide
QSALTQPASVSGSPGQSITISCTGTSSNIGTYKFVSWYQQHPDKAPKVLLYEVSKRPSGVSSRFSGSKSGNTASLTISGLQAEDQADYHCCSYAGSGTLLFGGGTKLTVL

SEQ ID NO: 660 - protein, 110 aa, Artificial Sequence
  Description of Artificial Sequence: Synthetic polypeptide
QSALTQPASVSGSPGQSITISCTGTSSDIGTYKFVSWYQQHPDKAPKVLLYEVSKRPSGVSSRFSGSKSDNTASLTISGLQAEDQADYHCCSYAGSGTLLFGGGTKLTVL

SEQ ID NO: 661 - protein, 110 aa, Artificial Sequence; identical to SEQ ID NO: 52
  Description of Artificial Sequence: Synthetic polypeptide

SEQ ID NO: 662 - protein, 7 aa, Artificial Sequence
  Description of Artificial Sequence: Synthetic peptide
NNNAAWS

SEQ ID NO: 663 - protein, 18 aa, Artificial Sequence
  Description of Artificial Sequence: Synthetic peptide
RTYYRSKWLYDYAVSVKS

SEQ ID NO: 664 - protein, 8 aa, Artificial Sequence
  Description of Artificial Sequence: Synthetic peptide
GYSSSFDY

SEQ ID NO: 665 - protein, 7 aa, Artificial Sequence
  Description of Artificial Sequence: Synthetic peptide
NNNGAWS

SEQ ID NO: 666 - protein, 7 aa, Artificial Sequence
  Description of Artificial Sequence: Synthetic peptide
NNNAAWT

SEQ ID NO: 667 - protein, 14 aa, Artificial Sequence
  Description of Artificial Sequence: Synthetic peptide
TGTSRDIGTYKFVS

SEQ ID NO: 668 - protein, 14 aa, Artificial Sequence
  Description of Artificial Sequence: Synthetic peptide
TGTSSNIGTYKFVS

SEQ ID NO: 669 - protein, 7 aa, Artificial Sequence
  Description of Artificial Sequence: Synthetic peptide
EVNKRPS

SEQ ID NO: 670 - protein, 10 aa, Artificial Sequence
  Description of Artificial Sequence: Synthetic peptide
CSYAGSGTLL

SEQ ID NO: 671 - protein, 14 aa, Artificial Sequence
  Description of Artificial Sequence: Synthetic peptide
TGTSSNIGTYKFVS

SEQ ID NO: 672 - protein, 14 aa, Artificial Sequence
  Description of Artificial Sequence: Synthetic peptide
TGTSRDIGTYKFVS

SEQ ID NO: 673 - protein, 7 aa, Artificial Sequence
  Description of Artificial Sequence: Synthetic peptide
EVSKRPS

SEQ ID NO: 674 - protein, 14 aa, Artificial Sequence
  Description of Artificial Sequence: Synthetic peptide
TGTSSDIGTYKFVS

SEQ ID NO: 675 - protein, 447 aa, Artificial Sequence
  Description of Artificial Sequence: Synthetic polypeptide
QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK

SEQ ID NO: 676 - protein, 216 aa, Artificial Sequence
  Description of Artificial Sequence: Synthetic polypeptide
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 677 - protein, 216 aa, Artificial Sequence
  Description of Artificial Sequence: Synthetic polypeptide
QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 678 - protein, 110 aa, Artificial Sequence
  Description of Artificial Sequence: Synthetic polypeptide
QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVL

SEQ ID NO: 679 - protein, 451 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSLKSRFTISRDNSKNTLYLQMNSLRAEDTAVYYCARDSYDSSLYVGDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 680 - protein, 214 aa, Artificial Sequence; identical to SEQ ID NO: 631
  Description of Artificial Sequence: Synthetic polypeptide

SEQ ID NO: 681 - protein, 124 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSLKSRFTISRDNSKNTLYLQMNSLRAEDTAVYYCARDSYDSSLYVGDYFDYWGQGTLVTVSS

SEQ ID NO: 682 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASYRATGIPARFSGSGSGTDFTLTISSLEPEDFAVYYCQQRRNWPLTFGQGTKVEIK

SEQ ID NO: 683 - protein, 17 aa, Artificial Sequence
  Description of Artificial Sequence: Synthetic peptide
EISGSGGYTNYADSLKS

SEQ ID NO: 684 - protein, 7 aa, Artificial Sequence
  Description of Artificial Sequence: Synthetic peptide
DASYRAT

SEQ ID NO: 685 - protein, 7 aa, Artificial Sequence
  Description of Artificial Sequence: Synthetic peptide
DASNRAT

SEQ ID NO: 686 - protein, 9 aa, Artificial Sequence
  Description of Artificial Sequence: Synthetic peptide
QQRRNWPLT

SEQ ID NO: 687 - protein, 120 aa, Artificial Sequence; identical to SEQ ID NO: 651
  Description of Artificial Sequence: Synthetic polypeptide

SEQ ID NO: 688 - protein, 110 aa, Artificial Sequence
  Description of Artificial Sequence: Synthetic polypeptide
QSALTQPASVSGSPGQSITISCTGTSRDIGTYKFVSWYQQHPDKAPKVLLYEVSKRPSGVSSRFSGSKSGNTASLTISGLQAEDQADYHCCSYAGSGTLLFGGGTKLTVL

SEQ ID NO: 689 - protein, 18 aa, Artificial Sequence
  Description of Artificial Sequence: Synthetic peptide
RTYYRSKWLYDYAVTVKS

SEQ ID NO: 690 - protein, 10 aa, Artificial Sequence
  Description of Artificial Sequence: Synthetic peptide
VSYAGSGTLL

SEQ ID NO: 691 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 692 - protein, 171 aa, Macaca fascicularis
MEHSTFLSGLVLATLLSQVSPFKIPVEELEDRVFVKCNTSVTWVEGTVGTLLTNNTRLDLGKRILDPRGIYRCNGTDIYKDKESAVQVHYRMCQNCVELDPATLAGIIVTDVIATLLLALGVFCFAGHETGRLSGAADTQALLRNDQVYQPLRDRDDAQYSRLGGNWARNK

SEQ ID NO: 693 - protein, 198 aa, Macaca fascicularis
MQSGTRWRVLGLCLLSIGVWGQDGNEEMGSITQTPYQVSISGTTVILTCSQHLGSEAQWQHNGKNKEDSGDRLFLPEFSEMEQSGYYVCYPRGSNPEDASHHLYLKARVCENCMEMDVMAVATIVIVDICITLGLLLLVYYWSKNRKAKAKPVTRGAGAGGRQRGQNKERPPPVPNPDYEPIRKGQQDLYSGLNQRRI

SEQ ID NO: 694-710 - skipped (17 entries)

SEQ ID NO: 711 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 712 - DNA, 360 bp, Artificial Sequence
  Description of Artificial Sequence: Synthetic polynucleotide
caggtgcagctgcagcagtctggccctagactcgtgcggccttcccagaccctgtctctgacctgtgccatctccggcgactccgtgttcaacaacaacgccgcctggtcctggatccggcagagcccttctagaggcctggaatggctgggccggacctactaccggtccaagtggctgtacgactacgccgtgtccgtgaagtcccggatcaccgtgaaccctgacacctcccggaaccagttcaccctgcagctgaactccgtgacccctgaggacaccgccctgtactactgcgccagaggctactcctcctccttcgactattggggccagggcaccctcgtgaccgtgtcctct

SEQ ID NO: 713 - DNA, 330 bp, Artificial Sequence
  Description of Artificial Sequence: Synthetic polynucleotide
cagtctgctctgacccagcctgcctccgtgtctggctctcccggccagtccatcaccatcagctgtaccggcacctcctccaacatcggcacctacaagttcgtgtcctggtatcagcagcaccccgacaaggcccccaaagtgctgctgtacgaggtgtccaagcggccctctggcgtgtcctccagattctccggctccaagtctggcaacaccgcctccctgaccatcagcggactgcaggctgaggaccaggccgactaccactgtgtgtcctacgctggctctggcaccctgctgtttggcggaggcaccaagctgaccgtgctg

SEQ ID NO: 714 - DNA, 360 bp, Artificial Sequence
  Description of Artificial Sequence: Synthetic polynucleotide
caggtgcagctgcagcagagcggccccggcctggtcaagcccagccagaccctgagcctgacctgcgccatcagcggcgacagcgtgttcaacaacaacgccgcctggtcctggatccgccagagccccagccgcggcctggagtggctgggccgcacctactaccgcagcaagtggctgtacgactacgccgtgtccgtgaagtcccgcatcaccatcaaccccgacaccagcaagaaccagttctccctgcagctgaacagcgtgacccccgaggacaccgccgtgtactactgcgcccgcggctacagcagcagcttcgactactggggccagggcaccctggtcaccgtgtccagc

SEQ ID NO: 715 - DNA, 330 bp, Artificial Sequence
  Description of Artificial Sequence: Synthetic polynucleotide
cagtctgctctgacccagcctgcctccgtgtctggctctcccggccagtccatcaccatcagctgtaccggcacctcctccaacatcggcacctacaagttcgtgtcctggtatcagcagcaccccggcaaggcccccaaagtgatgatctacgaggtgtccaagcggccctccggcgtgtccaacagattctccggctccaagtccggcaacaccgcctccctgacaatcagcggactgcaggccgaggacgaggccgactactactgtgtgtcctacgccggctctggcaccctgctgtttggcggcggaacaaagctgaccgtgctg

SEQ ID NO: 716 - protein, 4 aa, Unknown
  Description of Unknown: ER retention signal sequence
KDEL

SEQ ID NO: 717 - protein, 101 aa, Homo sapiens
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAR

SEQ ID NO: 718 - protein, 99 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTF

SEQ ID NO: 719 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 720 - protein, 752 aa, Mus sp.
MWNALQDRDSAEVLGHRQRWLRVGTLVLALTGTFLIGFLFGWFIKPSNEATGNVSHSGMKKEFLHELKAENIKKFLYNFTRTPHLAGTQNNFELAKQIHDQWKEFGLDLVELSHYDVLLSYPNKTHPNYISIINEDGNEIFKTSLSEQPPPGYENISDVVPPYSAFSPQGTPEGDLVYVNYARTEDFFKLEREMKISCSGKIVIARYGKVFRGNMVKNAQLAGAKGMILYSDPADYFVPAVKSYPDGWNLPGGGVQRGNVLNLNGAGDPLTPGYPANEHAYRHELTNAVGLPSIPVHPIGYDDAQKLLEHMGGPAPPDSSWKGGLKVPYNVGPGFAGNFSTQKVKMHIHSYTKVTRIYNVIGTLKGALEPDRYVILGGHRDAWVFGGIDPQSGAAVVHEIVRSFGTLKKKGRRPRRTILFASWDAEEFGLLGSTEWAEEHSRLLQERGVAYINADSSIEGNYTLRVDCTPLMYSLVYNLTKELQSPDEGFEGKSLYDSWKEKSPSPEFIGMPRISKLGSGNDFEVFFQRLGIASGRARYTKNWKTNKVSSYPLYHSVYETYELVVKFYDPTFKYHLTVAQVRGAMVFELANSIVLPFDCQSYAVALKKYADTIYNISMKHPQEMKAYMISFDSLFSAVNNFTDVASKFNQRLQELDKSNPILLRIMNDQLMYLERAFIDPLGLPGRPFYRHIIYAPSSHNKYAGESFPGIYDALFDISSKVNASKAWNEVKRQISIATFTVQAAAETLREVA

SEQ ID NO: 721 - protein, 750 aa, Macaca fascicularis
MWNLLHETDSAVATARRPRWLCAGALVLAGGFFLLGFLFGWFIKSSSEATNITPKHNMKAFLDELKAENIKKFLHNFTQIPHLAGTEQNFQLAKQIQSQWKEFGLDSVELTHYDVLLSYPNKTHPNYISIINEDGNEIFNTSLFEPPPAGYENVSDIVPPFSAFSPQGMPEGDLVYVNYARTEDFFKLERDMKINCSGKIVIARYGKVFRGNKVKNAQLAGATGVILYSDPDDYFAPGVKSYPDGWNLPGGGVQRGNILNLNGAGDPLTPGYPANEYAYRRGMAEAVGLPSIPVHPIGYYDAQKLLEKMGGSASPDSSWRGSLKVPYNVGPGFTGNFSTQKVKMHIHSTSEVTRIYNVIGTLRGAVEPDRYVILGGHRDSWVFGGIDPQSGAAVVHEIVRSFGMLKKEGWRPRRTILFASWDAEEFGLLGSTEWAEENSRLLQERGVAYINADSSIEGNYTLRVDCTPLMYSLVYNLTKELESPDEGFEGKSLYESWTKKSPSPEFSGMPRISKLGSGNDFEVFFQRLGIASGRARYTKNWETNKFSSYPLYHSVYETYELVEKFYDPMFKYHLTVAQVRGGMVFELANSVVLPFDCRDYAVVLRKYADKIYNISMKHPQEMKTYSVSFDSLFSAVKNFTEIASKFSERLRDFDKSNPILLRMMNDQLMFLERAFIDPLGLPDRPFYRHVIYAPSSHNKYAGESFPGIYDALFDIESKVDPSQAWGEVKRQISIATFTVQAAAETLSEVA

SEQ ID NO: 722 - protein, 76 aa, Artificial Sequence
  Description of Artificial Sequence: Synthetic polypeptide
EVQLLESGGGLVQPGGSLRLSCAASGFTFKSDAMHWVRQAPGKGLEWVSEISGSGGYTNYADSVKGRFTISRDNSK

SEQ ID NO: 723 - protein, 76 aa, Artificial Sequence
  Description of Artificial Sequence: Synthetic polypeptide
NTLYLQMNSLRAEDTAVYYCARDSYDSSLYVGDYFDYWGQGTLVTVSSASTKGPSVFPLAPSSKSTSGGTAALGCL

SEQ ID NO: 724 - protein, 75 aa, Artificial Sequence
  Description of Artificial Sequence: Synthetic polypeptide
VKDYFPEPVTVSWNSGALTSGVHTFPAVLQSSGLYSLSSVVTVPSSSLGTQTYICNVNHKPSNTKVDKKVEPKSC

SEQ ID NO: 725 - protein, 72 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFT

SEQ ID NO: 726 - protein, 72 aa, Artificial Sequence
  Description of Artificial Sequence: Synthetic polypeptide
LTISSLEPEDFAVYYCQQRSNWPLTFGQGTKVEIKRTVAAPSVFIFPPSDEQLKSGTASVVCLLNNFYPREA

SEQ ID NO: 727 - protein, 70 aa, Artificial Sequence
  Description of Artificial Sequence: Synthetic polypeptide
KVQWKVDNALQSGNSQESVTEQDSKDSTYSLSSTLTLSKADYEKHKVYACEVTHQGLSSPVTKSFNRGEC

SEQ ID NO: 728 - protein, 450 aa, artificial
  antibody
QVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGASSVFLFPPKPKDTLMISRTPEVTCVVVDVSAEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 729 - protein, 450 aa, Artificial Sequence
  antibody fragment
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGASSVFLFPPKPKDTLMISRTPEVTCVVVDVSAEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

What is claimed:

1. An isolated recombinant anti-CD3 antibody, or antigen-binding fragment thereof, comprising:
   a) a heavy chain comprising a heavy chain complementarity determining region (HCDR) 1 comprising SEQ ID NO: 662; a HCDR2 comprising SEQ ID NO: 663; and a HCDR3 comprising SEQ ID NO: 664 and a light chain comprising a light chain complementarity determining region (LCDR) 1 comprising SEQ ID NO:671, a LCDR2 comprising SEQ ID NO: 673, and a LCDR3 comprising SEQ ID NO: 690;
   b) a heavy chain variable region comprising SEQ ID NO: 652 and a light chain variable region comprising SEQ ID NO: 661;
   c) a heavy chain comprising SEQ ID NO: 640 and a light chain comprising SEQ ID NO: 676;
   d) a heavy chain variable region comprising SEQ ID NO: 657 and a light chain variable region comprising SEQ ID NO: 678; or
   e) a heavy chain comprising SEQ ID NO: 675 and a light chain comprising SEQ ID NO: 677.

2. The isolated recombinant anti-CD3 antibody or antigen-binding fragment thereof, of claim 1, wherein the antibody or antigen-binding fragment specifically binds *Macaca fascicularis* or human CD3d, or CD3e, or CD3e and CD3d with a binding affinity of about 300 nM or less.

3. The isolated recombinant anti-CD3 antibody or antigen-binding fragment thereof of claim 2, wherein the binding affinity is about 100 nM or less.

4. The isolated recombinant anti-CD3 antibody or antigen-binding fragment thereof of claim 2, wherein the binding affinity is measured by flow cytometry or by ProteOn surface plasmon resonance assay ProteOn XPR36 system at +25° C.

5. The isolated recombinant anti-CD3 antibody or antigen-binding fragment thereof of claim 2, wherein the antibody or antigen-binding fragment has one, two, three, or four of the following properties:
   a) binds human and *Macaca fascicularis* CD3+T lymphocytes with a calculated EC50 of 300 nM or less and binds *Macaca fascicularis* CD3-expressing HEK cells with a calculated EC50 of 300 nM or less, wherein the difference in calculated EC50 between binding CD3+T lymphocytes and binding *Macaca fascicularis* CD3-expressing HEK cells is less than 5-fold, and wherein the calculated EC50 is measured in a whole cell binding assay at 0° C. using flow cytometry;
   b) binds recombinant CD3d from human (SEQ ID NO:691), or binds recombinant CD3e from human (SEQ ID NO:636), or binds recombinant CD3d from *Macaca fascicularis* (SEQ ID NO:692), or binds recombinant CD3e from *Macaca fascicularis* (SEQ ID NO:693) with an equilibrium dissociation constant ($K_D$) of 300 nM or less, wherein the $K_D$ is measured using Proteon surface plasmon resonance assay ProteOn XPR36 system at +25° C.;
   c) binds residues 1-6 of CD3e as determined by X-ray crystallography; or
   d) activates T cells or induces CD69 expression to a similar degree as cOKT3 or SP34-2 as determined by fluorescence-activated cell sorting assay.

6. The antibody or antigen-binding fragment thereof of claim 2 comprising at least one substitution in an antibody constant domain, the at least one substitution comprising:
   a) heavy chain substitutions K409R, F405L, or F405L and R409K;
   b) heavy chain substitutions S228P, F234A, and L235A;
   c) heavy chain substitutions L234A, G237A, P238S, H268A, A330S and P331S, wherein the antibody is an IgG1 isotype; or
   d) heavy chain substitution S228P, wherein the antibody is an IgG4 isotype;
   wherein residue numbering is according to the EU Index.

7. The antibody or antigen-binding fragment thereof of claim 2, comprising the HCDR1, the HCDR2, the HCDR3, the LCDR1, the LCDR2, and the LCDR3 of SEQ ID NOs:662, 663, 664, 671, 673, and 690, respectively.

8. The antibody or antigen-binding fragment thereof of claim 2, comprising the heavy chain variable region (VH) and the light chain variable region (VL) of SEQ ID NOs: 652 and 661, respectively.

9. The antibody or antigen-binding fragment thereof of claim 2, comprising the heavy chain sequence (HC) and the light chain sequence (LC) of SEQ ID NOs: 640 and 676, respectively.

10. The antibody or antigen-binding fragment thereof of claim 2, comprising a VH and a VL of SEQ ID NOs:657 and 678, respectively.

11. The antibody or antigen-binding fragment thereof of claim 2, comprising a HC and a LC of SEQ ID NOs:675 and 677, respectively.

12. An antibody or antigen-binding fragment thereof, comprising a HCDR1, a HCDR2, a HCDR3, a LCDR1, a LCDR2, and a LCDR3 of SEQ ID NOs: 662, 663, 664, 671, 673, and 690, respectively.

13. An antibody or antigen-binding fragment thereof, comprising a VH and a VL of SEQ ID NOs:652 and 661, respectively.

14. An antibody or antigen-binding fragment thereof, comprising a HC and a LC of SEQ ID NOs:640 and 676, respectively.

15. An antibody or antigen-binding fragment thereof, comprising a VH and a VL of SEQ ID NOs:657 and 678, respectively.

16. An antibody or antigen-binding fragment thereof, comprising a HC and a LC of SEQ ID NOs:675 and 677, respectively.

17. The antibody or antigen-binding fragment thereof of claim 2, wherein the antibody is human or humanized.

18. The antibody of claim 17, wherein the antibody is an IgG4 or IgG1 isotype.

19. The antibody of claim 18, comprising one, two, three, four, five, six, seven, eight, nine or ten substitutions in the antibody Fc.

20. An antibody or antigen-binding fragment thereof, comprising a HC of SEQ ID NO:640 and a LC of SEQ ID NOs:646, comprising at least one substitution comprising:
   a) D43G, L49M, L50I, S62N, Q85E light chain substitutions;
   b) D43G, V48L, L49M, L50I, S62N, Q85E, H89Y light chain substitutions;
   c) R10G, R13K, V73I, R70K, T83S, L96V heavy chain substitutions;
   d) any one of light chain substitutions D43G, V48L, L49M, L50I, S62N, Q85E, or H89Y; or
   e) any one of heavy chain substitutions R10G, R13K, V73I, R79K, T83S, or L96V,
      wherein residue numbering is according to the EU Index.

21. The antibody of claim 2, wherein the antibody is bispecific or multispecific.

22. A bispecific antibody comprising a first domain that specifically binds CD3 and a second domain that specifically binds a second antigen, wherein the first domain comprises the HCDR1, the HCDR2, the HCDR3, the LCDR1, the LCDR2, and the LCDR3 of SEQ ID NOs:662, 663, 664, 671, 673, and 690, respectively.

23. The bispecific antibody of claim 22 wherein the first domain and second domain are an IgG4 isotype, and wherein the first or the second domain comprises S228P, F234A, L235A, F405L and R409K heavy chain substitutions and the other domain of the first or the second domain comprises S228P, F234A and L235A heavy chain substitution, wherein residue numbering is according to the EU Index.

24. The bispecific antibody of claim 22, wherein the first and/or the second domain comprises at least one substitution in a CH3 constant domain comprising a F405L, or F405L and R409K substitution, wherein residue numbering is according to the EU Index.

25. The bispecific antibody of claim 22, wherein one of the first or the second domains comprises a F405L heavy chain substitution and the other of the first or second domains comprises a K409R heavy chain substitution, wherein residue numbering is according to the EU Index.

26. The bispecific antibody of claim 22, wherein the first domain and the second domain are an IgG4 isotype, wherein one of the first or the second domains comprises a S228P heavy chain substitution and the other of the first or the second domains comprises S228P, F405L and R409K heavy chain substitutions, wherein residue numbering is according to the EU Index.

27. The bispecific antibody of claim 22, wherein the first domain comprises the VH and the VL of SEQ ID NOs: 652 and 661, respectively.

28. The bispecific antibody of claim 22, wherein the first domain comprises the HC and the LC of SEQ ID NOs: 640 and 676, respectively.

29. The bispecific antibody of claim 22, wherein the first domain comprises the VH and the VL of SEQ ID NOs:657 and 678, respectively.

30. The bispecific antibody of claim 22, wherein the first domain comprises the HC and the LC of SEQ ID NOs:675 and 677, respectively.

31. The bispecific antibody of claim 22, wherein the second antigen is a cell surface antigen that is expressed on a target cell other than an immune effector cell.

32. The bispecific antibody of claim 31, wherein the cell surface antigen is a tumor associated antigen.

33. The bispecific antibody of claim 22, wherein the second antigen is CD33, IL1RAP, PSMA or TMEFF2.

34. A pharmaceutical composition comprising the antibody of claim 1 and a pharmaceutically acceptable carrier.

35. A polynucleotide encoding the antibody of claim 2.

36. A vector comprising the polynucleotide of claim 35.

37. A host cell comprising the vector of claim 36.

38. A method of producing the antibody of claim 2, comprising culturing the host cell of claim 37 in conditions that the antibody is expressed, and recovering the antibody produced by the host cell.

39. A method of treating a cancer in a subject, comprising administering a therapeutically effective amount of the isolated antibody of claim 2 to the subject in need thereof for a time sufficient to treat the cancer.

40. The method of claim 39, wherein the cancer is a solid tumor or a hematological malignancy.

41. The method of claim 40, wherein the solid tumor is a prostate cancer, a colorectal cancer, a gastric cancer, a clear cell renal carcinoma, a bladder cancer, a lung cancer, a squamous cell carcinoma, a glioma, a breast cancer, a kidney cancer, a neovascular disorder, a clear cell renal carcinoma (CCRCC), a pancreatic cancer, a renal cancer, a urothelial cancer or an adenocarcinoma to the liver.

42. The method of claim 41, wherein the prostate cancer is a refractory prostate cancer, a prostatic intraepithelial neoplasia, an androgen independent prostate cancer, or a malignant prostate cancer.

43. The method of claim 40, wherein the hematological malignancy is acute myeloid leukemia (AML), myelodysplastic syndrome (MDS), acute lymphocytic leukemia (ALL), diffuse large B-cell lymphoma (DLBCL), chronic myeloid leukemia (CML) or blastic plasmacytoid dendritic cell neoplasm (DPDCN).

44. The method of claim 39, wherein the antibody is administered in combination with a second therapeutic agent.

45. The antibody of claim 1 for use in therapy.

* * * * *